United States Patent
Ngo et al.

(10) Patent No.: US 11,059,864 B2
(45) Date of Patent: Jul. 13, 2021

(54) CHIMERIC ANTIGEN RECEPTOR (CAR) MODULATION

(71) Applicant: TRUSTEES OF BOSTON UNIVERSITY, Boston, MA (US)

(72) Inventors: John Ngo, Cambridge, MA (US); Wilson Wong, Brookline, MA (US); Meng Lai Nicole Wong, Watertown, MA (US); Huishan Li, Brookline, MA (US); Elliot P. Tague, Brookline, MA (US)

(73) Assignee: TRUSTEES OF BOSTON UNIVERSITY, Boston, MA (US)

( * ) Notice: Subject to any disclaimer, the term of this patent is extended or adjusted under 35 U.S.C. 154(b) by 0 days.

(21) Appl. No.: 16/832,751

(22) Filed: Mar. 27, 2020

(65) Prior Publication Data
US 2020/0308234 A1   Oct. 1, 2020

Related U.S. Application Data

(60) Provisional application No. 62/826,139, filed on Mar. 29, 2019.

(51) Int. Cl.
*C07K 14/18* (2006.01)
*C07K 14/81* (2006.01)

(52) U.S. Cl.
CPC ........ *C07K 14/1833* (2013.01); *C07K 14/811* (2013.01); *C07K 2319/02* (2013.01); *C07K 2319/03* (2013.01); *C07K 2319/50* (2013.01); *C07K 2319/80* (2013.01)

(58) Field of Classification Search
CPC .................. C12K 2319/02; C07K 2319/80
See application file for complete search history.

(56) References Cited

U.S. PATENT DOCUMENTS

| | | |
|---|---|---|
| 6,333,186 B1 | 12/2001 | Wittekind et al. |
| 7,208,309 B2 | 4/2007 | Kukolj et al. |
| 7,494,660 B2 | 2/2009 | Lin et al. |
| 9,889,160 B2 | 2/2018 | Jantz et al. |
| 10,137,180 B2 | 11/2018 | Wandless et al. |
| 2002/0106642 A1 | 8/2002 | Wittekind et al. |
| 2017/0157176 A1 | 6/2017 | Wang et al. |
| 2018/0011096 A1 | 1/2018 | Chien et al. |
| 2018/0179522 A1 | 6/2018 | Buckley et al. |

FOREIGN PATENT DOCUMENTS

| | | | |
|---|---|---|---|
| WO | 2016/210447 A1 | | 12/2016 |
| WO | 2018/206791 A1 | | 11/2018 |
| WO | 2019118518 A2 | | 6/2019 |
| WO | WO 2020/118076 | * | 6/2020 |

OTHER PUBLICATIONS

Forst "Recognition of mono-ADP-ribosylated ARTD10 substrates by ARTD8 macrodomains and acetylation of ARTD10." Thesis Diss. Rheinisch-Westfälische Technische Hochschule (RWTH) Aachen University, (2013).
Schmidt "Design of an allosterically controlled serpin-based drug shuttle for the delivery of doxycycline and doxorubicin." Thesis Diss. Friedrich-Alexander-University Erlangen-Nuremberg, (2018).
Banaszynski et al., "A rapid, reversible, and tunable method to regulate protein function in living cells using synthetic small molecules." Cell 126(5): 995-1004 (2006).
Bonger et al., "Small molecule displacement of a cryptic degron causes conditional protein degradation" Nat. Biol. Chem. (2011) 7(8):531-537.
Cunningham-Bryant et al., "A chemically disrupted proximity system for controlling dynamic cellular processes." Journal of the American Chemical Society 141(8): 3352-3355 (2019).
Foight et al., "Multi-input chemical control of protein dimerization for programming graded cellular responses." Nature biotechnology 37(10): 1209-1216 (2019).
Gonda et al., "Universality and Structure of the N-end Rule", The Journal of Biological Chemistry 264(28): 16700-16712 (1989).
Kliemann et al., "Polymorphisms and resistance mutations of hepatitis C virus on sequences in the European hepatitis C virus database." World journal of gastroenterology 22(40): 8910-8917 (2016).
Kugler et al., "High affinity peptide inhibitors of the hepatitis C virus NS3-4A protease refractory to common resistant mutants." Journal of Biological Chemistry 287(46): 39224-39232 (2012).
Lin "HCV NS3-4A Serine Protease" Hepatitis C Viruses: Genomes and Molecular Biology, Chapter 6: 163-206 (2006).
McCauley et al., "Hepatitis C virus NS3/4a protease inhibitors." Current opinion in pharmacology 30: 84-92 (2016).
Schrader et al., "Making it easier to regulate protein stability." Chemistry & biology 17(9): 917-918 (2010).
Sheridan et al., "Selectable one-step PCR-mediated integration of a degron for rapid depletion of endogenous human proteins." BioTechniques 60(2): 69-74 (2016).
Sun et al., "Analysis of Naturally Occurring Resistance-Associated Variants to NS3/4A Protein Inhibitors, NS5A Protein Inhibitors, and NS5B Polymerase Inhibitors in Patients With Chronic Hepatitis C." Gene Expression The Journal of Liver Research 18(1): 63-69 (2018).

* cited by examiner

*Primary Examiner* — Suzanne M Noakes
(74) *Attorney, Agent, or Firm* — Nixon Peabody LLP; Ronald I. Eisenstein; Nicole D. Kling

(57) ABSTRACT

The technology described herein is directed to CAR polypeptides and systems comprising repressible proteases. In combination with a specific protease inhibitor, the activity of said CAR polypeptides and systems and cells comprising them can be modulated. Also described herein are methods of using said CAR polypeptides and systems, for example to treat various diseases and disorders.

23 Claims, 30 Drawing Sheets
Specification includes a Sequence Listing.

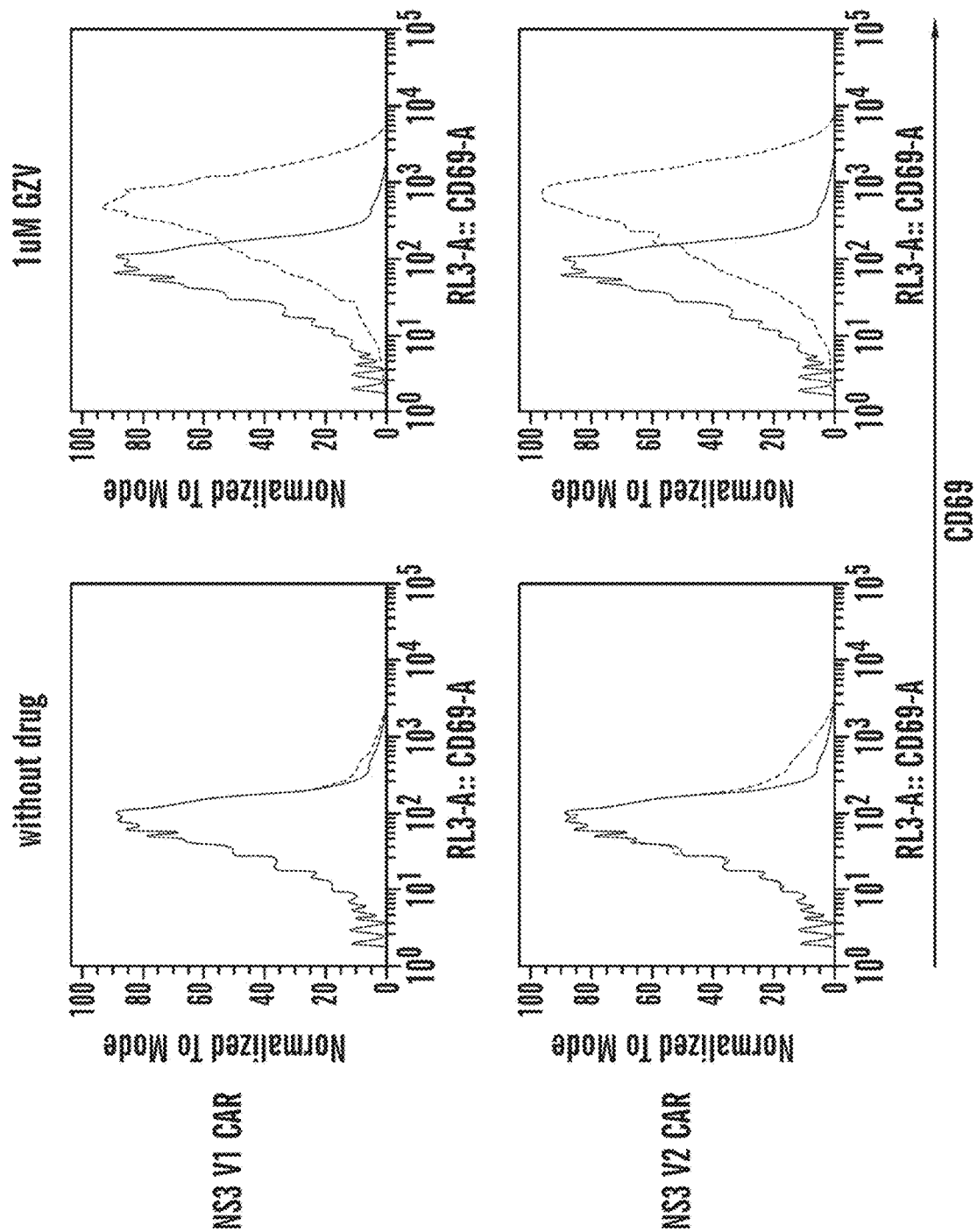
Fig. 4B, CONT.

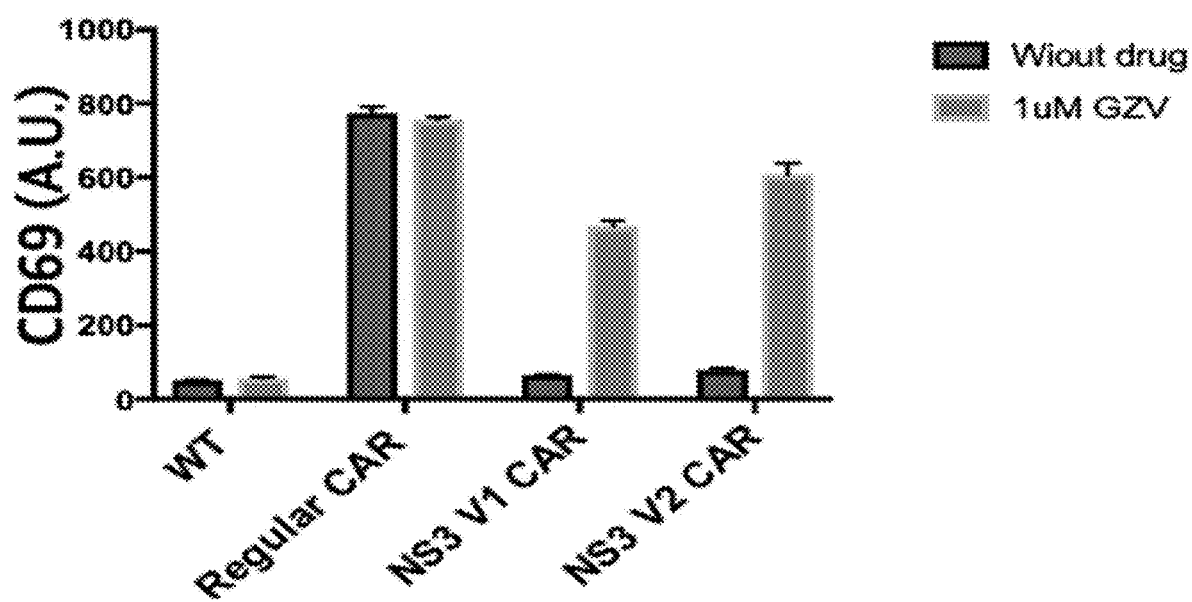
Fig. 4B, CONT.

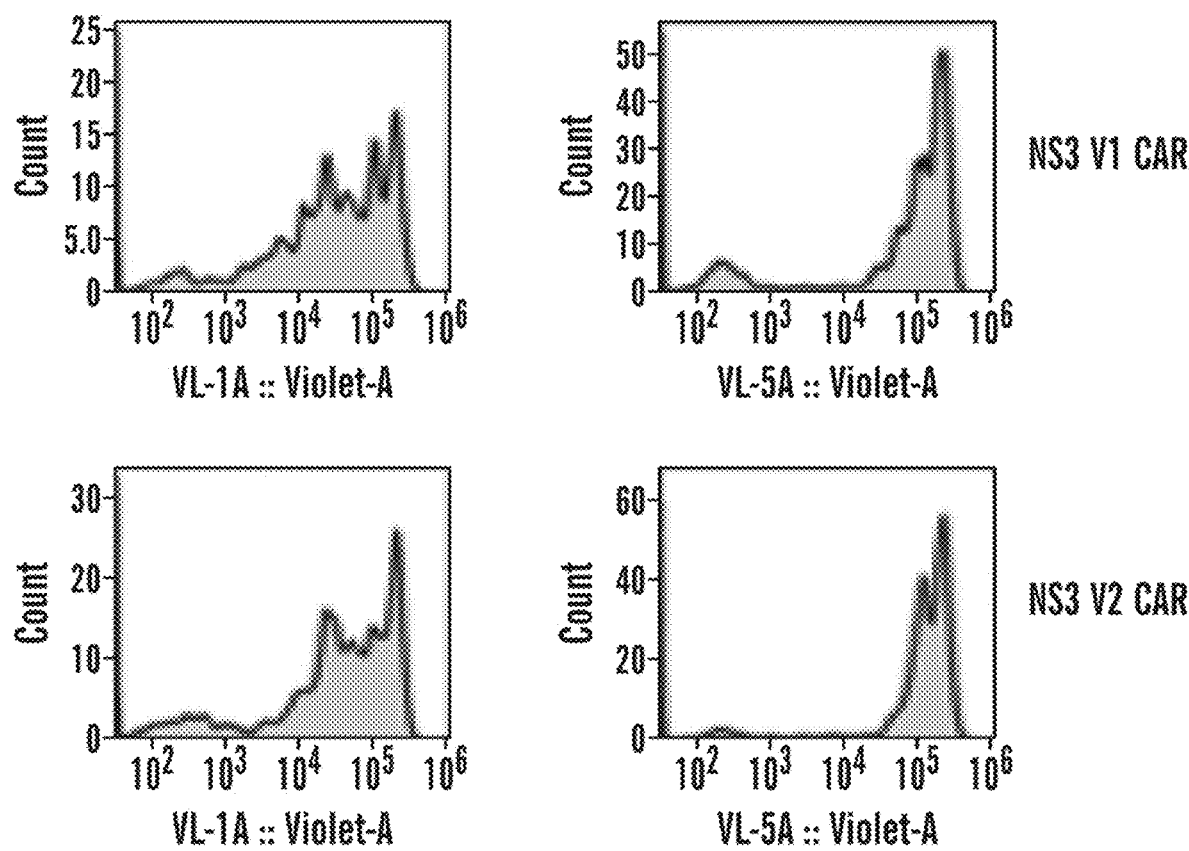
Fig. 4C, CONT.

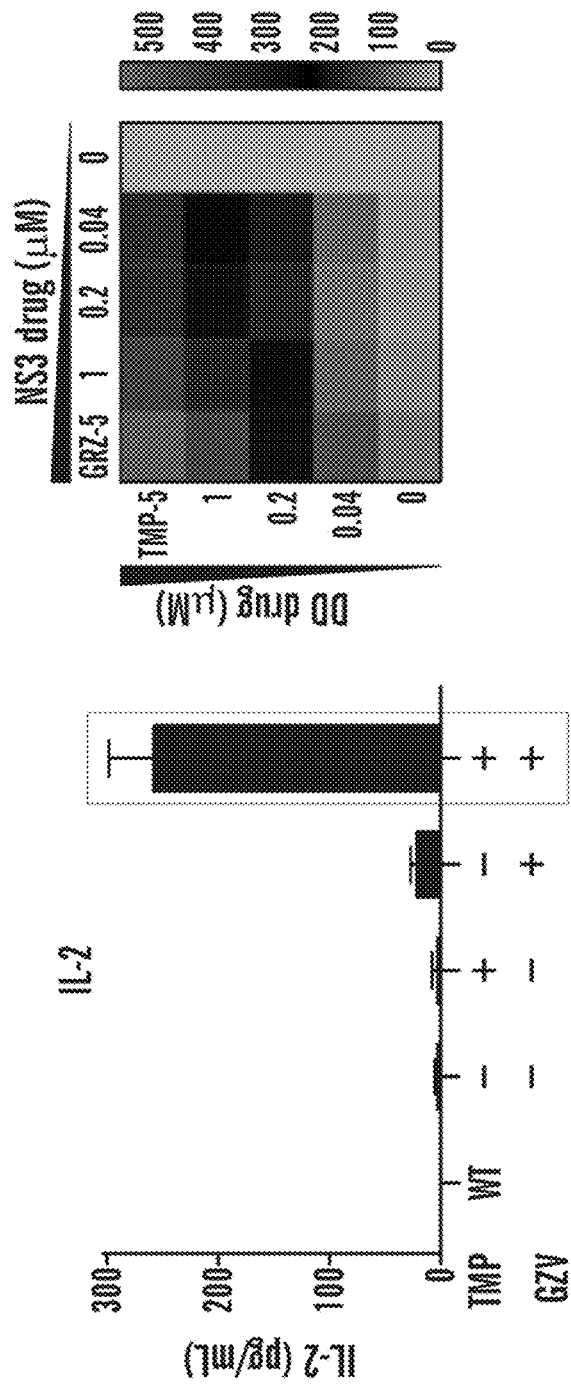
Fig. 6B, CONT.

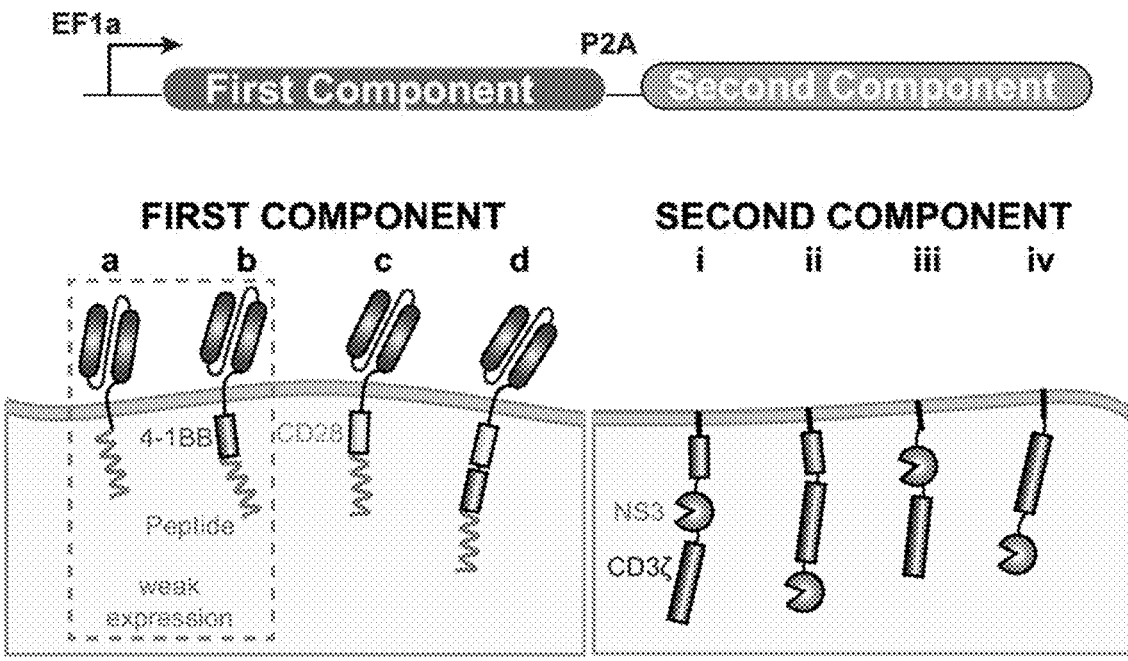
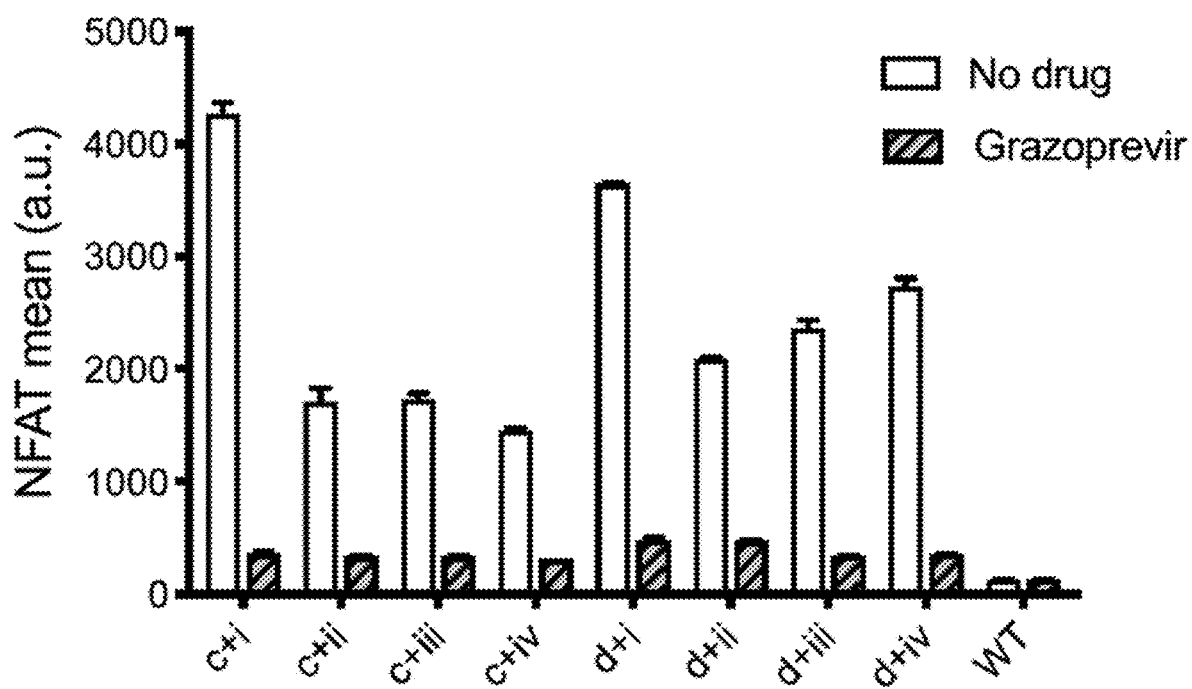
Fig. 9A
Fig. 9B

NS3 OFF CAR

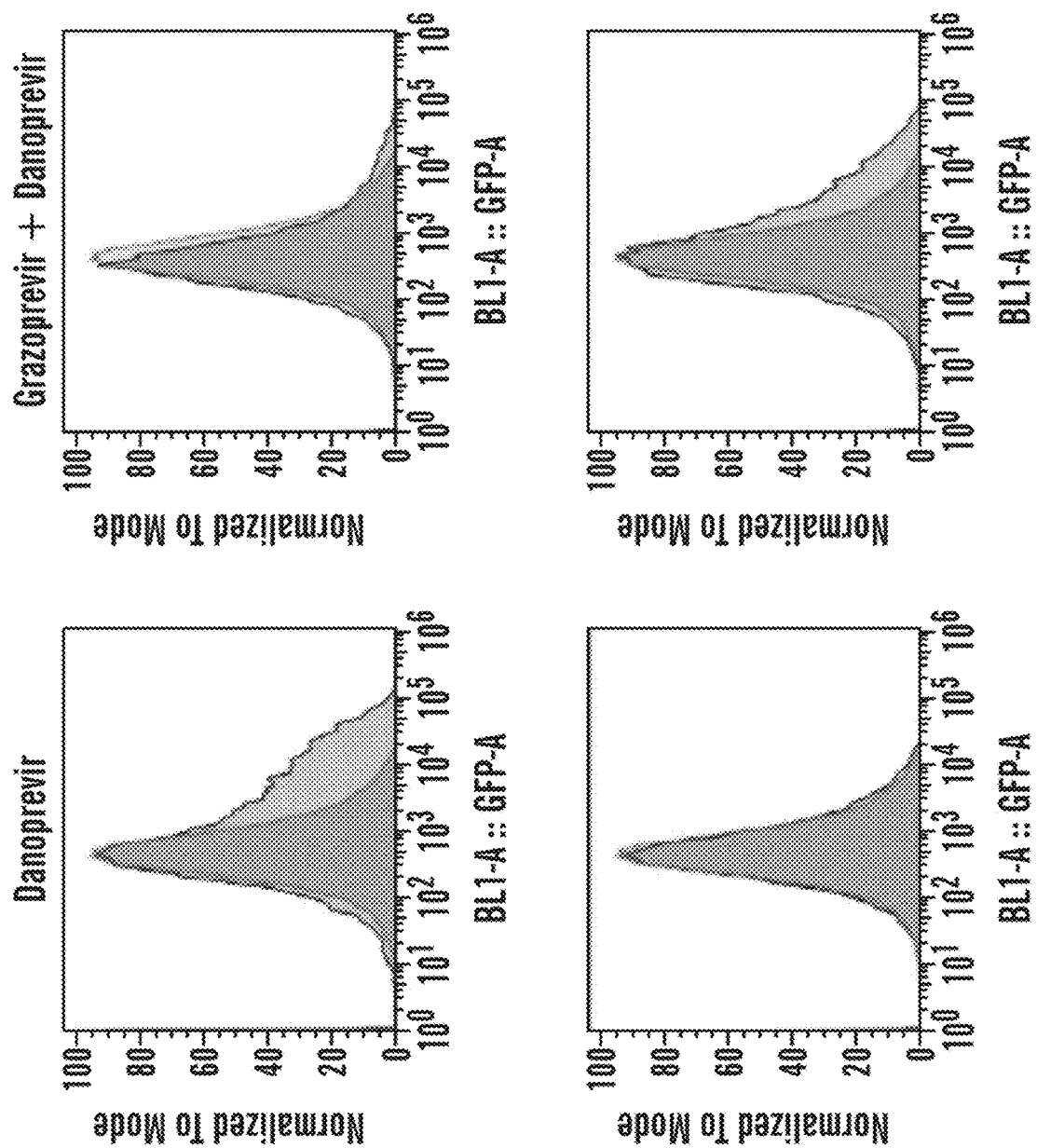
Fig. 12B, CONT.

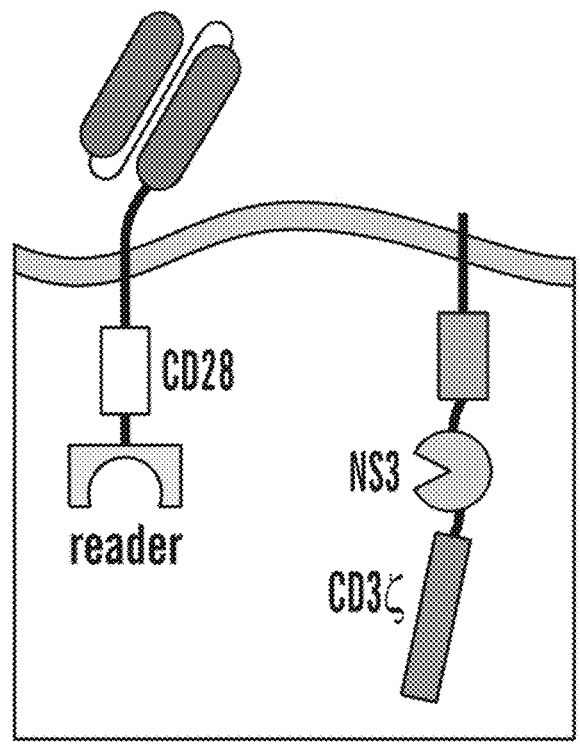
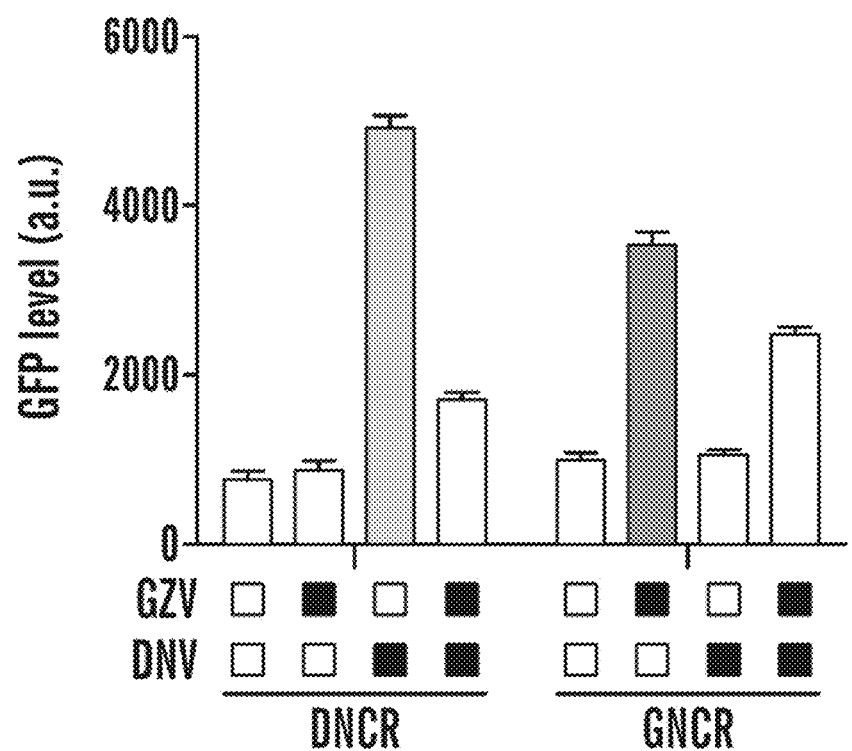
Fig. 12B, CONT.

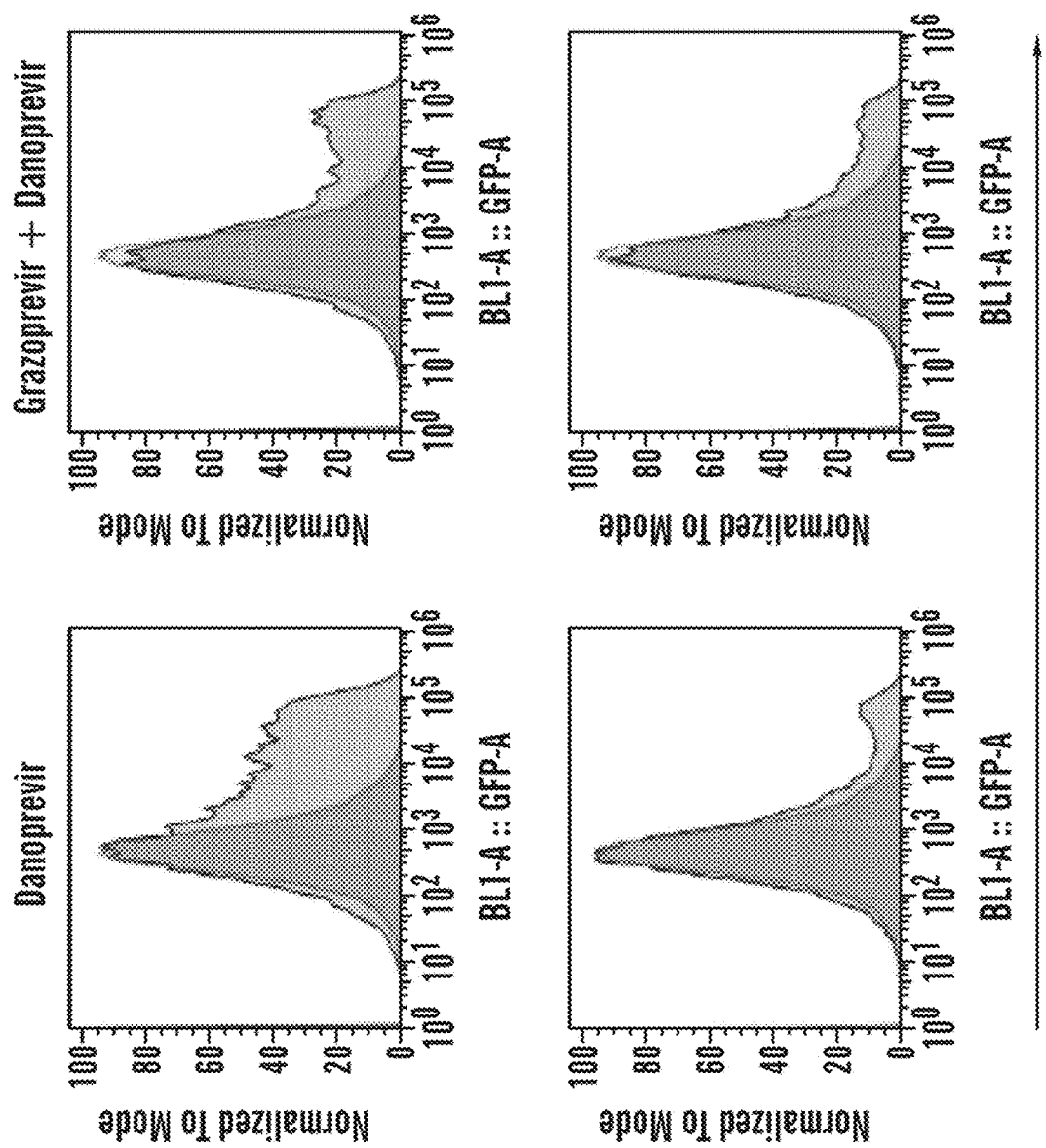
Fig. 12C, CONT.

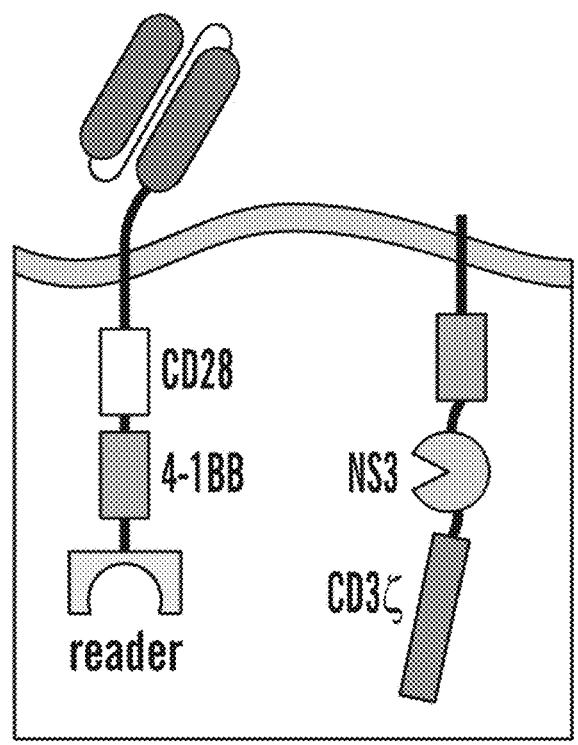
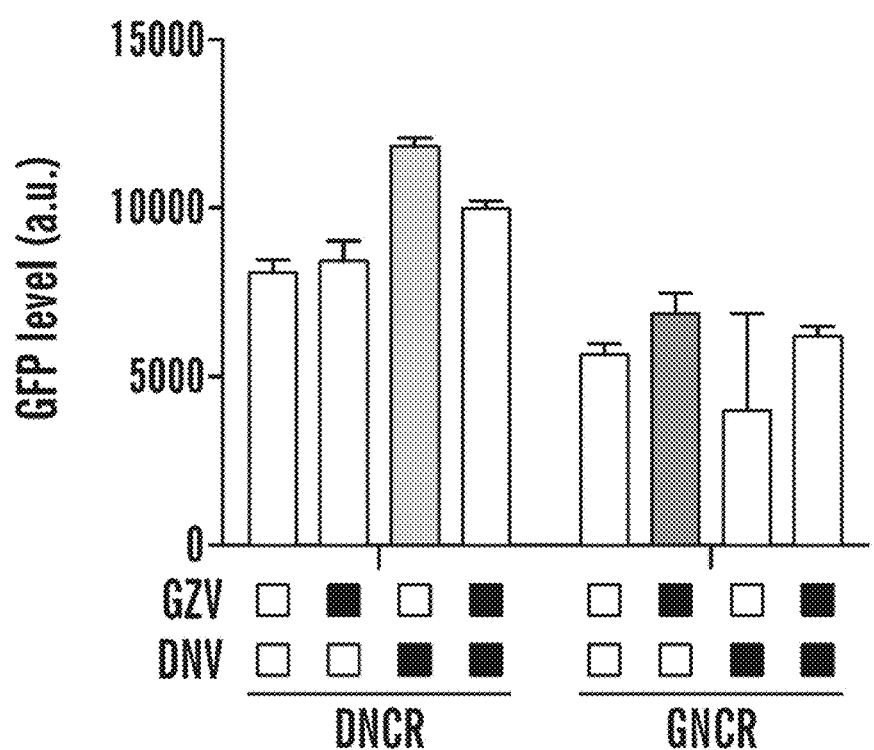
Fig. 12C, CONT.

CHIMERIC ANTIGEN RECEPTOR (CAR) MODULATION

CROSS-REFERENCE TO RELATED APPLICATIONS

This application claims benefit under 35 U.S.C. § 119(e) of U.S. Provisional Application No. 62/826,139 filed Mar. 29, 2019, the contents of which are incorporated herein by reference in their entirety.

SEQUENCE LISTING

The instant application contains a Sequence Listing which has been submitted in ASCII format via EFS-Web and is hereby incorporated by reference in its entirety. Said ASCII copy, created on, Jan. 5, 2021, is named 701586-094980US-PT_SL-2.txt and is 855,959 bytes in size.

TECHNICAL FIELD

The technology described herein relates to compositions, systems, and methods directed at chimeric antigen receptor (CAR) modulation.

BACKGROUND

Adoptive T cell therapy represents one of the most exciting forms of cancer therapy. Two approved CAR T cell therapies developed by NOVARTIS and KITE PHARMA/GILEAD are being used to treat acute lymphoblastic leukemia (ALL) and lymphoma respectively. Though clinical results have been promising, T cell overactivity leading to cytokine release syndrome (CRS) is still a major issue to contend with. Such cytokine storms can lead to organ failure or death in severe cases. While drug-inducible suicide switches have been developed to kill overactive T cells, this is an irreversible action as these cells can no longer be reused. Considering the high cost of CAR-T therapy, such a suicide-switch approach can be disagreeable to patients who may require future use of the engineered cells. Furthermore, while several inducible switches are currently available, none of them are regulated by FDA-approved molecules. As such, there is an urgent need for safety-control switch CAR technology, especially if the control-switch makes use of an FDA-approved drug with a favorable toxicity profile and pharmacokinetics.

SUMMARY

The technology described herein is directed to drug-inducible and drug-repressible CAR polypeptides and systems. In particular, described herein are CAR polypeptides comprising a repressible protease, such that the activity of the CAR polypeptide can be controlled by a protease inhibitor. The CAR polypeptides also comprise additional components such that presence of a specific protease inhibitor either activates or inactivates the CAR polypeptide, thus activating or inactivating the anti-cancer activity of the cell expressing the polypeptide. Such cellular activation or inactivation can be reversible, upon removal of the protease inhibitor.

In particular embodiments, the repressible protease is the non-structural protein 3 (NS3) protease domain, which originates from the hepatitis C virus (HCV). The NS3 protease is especially useful as multiple protease inhibitors (e.g., danoprevir and grazoprevir amongst others) are approved for administration to human subjects, with a demonstrated safety profile. Varying the concentration of the protease inhibitor can modulate the CAR polypeptide activity, thus allowing for a technology that is customizable to the patient. The CAR polypeptides described herein thus provide flexible control over T cell activity and improve the safety of adoptive T cell therapy. The NS3 CAR polypeptides described herein are also functional in NK cells and regulatory T cells.

Described herein are four general frameworks of drug-controllable CAR polypeptides and systems comprising repressible proteases: (1) drug-inducible CAR polypeptides (i.e., ON-switches); (2) drug-inducible two-component logic-switch CAR polypeptide systems (i.e., AND-gates); (3) drug-repressible CAR polypeptide systems (i.e., OFF-switches); and (4) drug-inducible reader CAR polypeptide systems that are responsive to a specific protease inhibitor (i.e., reader CARs). Also described herein are polynucleotides and vectors encoding said CAR polypeptides, cells expressing said CAR polypeptides, pharmaceutical compositions comprising said CAR polypeptides, and methods of using said CAR polypeptides.

In one aspect described herein is a polypeptide comprising: (a) an extracellular binding domain; (b) a transmembrane domain; (c) at least one intracellular signaling domain; and (d) a repressible protease.

In some embodiments of any of the aspects, the repressible protease is located: (a) between the transmembrane domain and the first intracellular signaling domain; (b) between the first intracellular signaling domain and the second intracellular signaling domain; or (c) between the second intracellular signaling domain and the third intracellular signaling domain.

In some embodiments of any of the aspects, the repressible protease is hepatitis C virus (HCV) nonstructural protein 3 (NS3).

In some embodiments of any of the aspects, the polypeptide further comprises a cofactor for the repressible protease.

In some embodiments of any of the aspects, the cofactor is an HSV NS4A domain.

In some embodiments of any of the aspects, the HSV NS4A domain is adjacent and N-terminal to the repressible protease.

In some embodiments of any of the aspects, the polypeptide further comprises at least one protease cleavage site of the repressible protease.

In some embodiments of any of the aspects, the repressible protease and the at least one protease cleavage site are physically linked to one another.

In some embodiments of any of the aspects, in the at least one protease cleavage site is located: (a) between the transmembrane domain and the first intracellular signaling domain; (b) between the first intracellular signaling domain and the second intracellular signaling domain; and/or (c) between the second intracellular signaling domain and the third intracellular signaling domain.

In some embodiments of any of the aspects, the polypeptide is cleaved when a protease inhibitor is not bound to the repressible protease.

In some embodiments of any of the aspects, the N-terminal amino acid of the cleaved polypeptide is associated with a high degradation rate and a low half-life.

In some embodiments of any of the aspects, the polypeptide is in combination with a protease inhibitor bound to the repressible protease.

In some embodiments of any of the aspects, the protease inhibitor is selected from grazoprevir (GZV), danoprevir, simeprevir, asunaprevir, ciluprevir, boceprevir, sovaprevir, paritaprevir, ombitasvir, paritaprevir, ritonavir, dasabuvir, and telaprevir.

In some embodiments of any of the aspects, the polypeptide is not cleaved when the protease inhibitor is bound to the repressible protease.

In some embodiments of any of the aspects, the polypeptide comprises from the N-terminus to the C-terminus: (a) an extracellular binding domain; (b) a transmembrane domain; (c) at least one intracellular signaling domain; (d) a first protease cleavage site; (e) a repressible protease; (f) a second protease cleavage site; and (g) at least one intracellular signaling domain.

In some embodiments of any of the aspects, the polypeptide comprises from the N-terminus to the C-terminus: (a) an extracellular binding domain; (b) a transmembrane domain; (c) a first intracellular signaling domain; (d) a second intracellular signaling domain; (e) a first protease cleavage site; (f) a repressible protease; (g) a second protease cleavage site; and (h) a third intracellular signaling domain.

In some embodiments of any of the aspects, the polypeptide comprises from the N-terminus to the C-terminus: (a) an extracellular binding domain; (b) a transmembrane domain; (c) a first intracellular signaling domain; (d) a first protease cleavage site; (e) a repressible protease; (f) a second protease cleavage site; (g) a second intracellular signaling domain; and (h) a third intracellular signaling domain.

In some embodiments of any of the aspects, the polypeptide comprises from the N-terminus to the C-terminus: (a) an extracellular binding domain; (b) a transmembrane domain; (c) a first protease cleavage site; (d) a repressible protease; (e) a second protease cleavage site; and (f) at least one intracellular signaling domain.

In some embodiments of any of the aspects, the polypeptide comprises from the N-terminus to the C-terminus: (a) an extracellular binding domain; (b) a transmembrane domain; (c) a first protease cleavage site; (d) a repressible protease; (e) a second protease cleavage site; (f) a first intracellular signaling domain; (g) a second intracellular signaling domain; and (h) a third intracellular signaling domain.

In some embodiments of any of the aspects, the at least one intracellular signaling domain comprises first and second intracellular signaling domains.

In some embodiments of any of the aspects, the at least one intracellular signaling domain comprises first, second, and third intracellular signaling domains.

In some embodiments of any of the aspects, each of the at least one intracellular signaling domains independently comprises an intracellular signaling domain selected from the group consisting of: TCRC; FcRy; FcRp; CD3zeta; CD3y; CD35; CD3s; CD3C; CD22; CD79a; CD79b; CD66d; CARD 11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-L1); CD278 (ICOS); DAP10; LAT; KD2C SLP76; TRIM; ZAP70; and 41BB.

In some embodiments of any of the aspects, the first, second, and third intracellular signaling domains comprise the intracellular signaling domains of CD28, 4-1BB, and CD3zeta, respectively.

In some embodiments of any of the aspects, the transmembrane domain is located between the extracellular binding domain and the at least one intracellular signaling domain.

In some embodiments of any of the aspects, the transmembrane domain comprises the transmembrane domain of CD28.

In some embodiments of any of the aspects, the extracellular binding domain is an antibody, an antigen-binding fragment thereof, a F(ab) fragment, a F(ab') fragment, a single chain variable fragment (scFv), or a single-domain antibody (sdAb).

In some embodiments of any of the aspects, the extracellular binding domain comprises a scFv.

In some embodiments of any of the aspects, the extracellular binding domain specifically binds to a tumor antigen.

In some embodiments of any of the aspects, the polypeptide further comprises a leading peptide located N-terminal to the extracellular binding domain.

In some embodiments of any of the aspects, the leading peptide is a CD8alpha leading peptide.

In some embodiments of any of the aspects, the polypeptide further comprises a spacer domain located between the extracellular binding domain and the transmembrane domain.

In some embodiments of any of the aspects, the spacer domain comprises a CD8 hinge domain.

In some embodiments of any of the aspects, the polypeptide further comprises a first detectable marker adjacent to and C terminal of the extracellular binding domain.

In some embodiments of any of the aspects, the polypeptide further comprises a second detectable marker adjacent and N-terminal to the repressible protease.

In some embodiments of any of the aspects, the polypeptide further comprises a third detectable marker adjacent to and C-terminal to the repressible protease.

In some embodiments of any of the aspects, the first, second, or third detectable marker is selected from GFP, V5, HA1, Myc, VSV-G, HSV, FLAG, HIS, mCherry, AU1, and biotin.

In some embodiments of any of the aspects, the polypeptide comprises one of SEQ ID NO: 34-36 or a sequence that is at least 70% identical to one of SEQ ID NO: 34-36 that maintains the same function.

In one aspect described herein is a polypeptide comprising: (a) an extracellular binding domain; (b) a transmembrane domain; (c) a repressible protease; and (d) at least one intracellular signaling domain.

In some embodiments of any of the aspects, the repressible protease is hepatitis C virus (HCV) nonstructural protein 3 (NS3).

In some embodiments of any of the aspects, the polypeptide further comprises a cofactor for the repressible protease.

In some embodiments of any of the aspects, the cofactor is an HSV NS4A domain.

In some embodiments of any of the aspects, the HSV NS4A domain is adjacent and N-terminal to the repressible protease.

In some embodiments of any of the aspects, the polypeptide further comprises at least one protease cleavage site of the repressible protease.

In some embodiments of any of the aspects, the repressible protease and the at least one protease cleavage site are physically linked to one another.

In some embodiments of any of the aspects, the repressible protease and at least one protease cleavage site are located in between the transmembrane domain and the intracellular signalling domain.

In some embodiments of any of the aspects, the polypeptide is cleaved when a protease inhibitor is not bound to the repressible protease.

In some embodiments of any of the aspects, the N-terminal amino acid of the cleaved polypeptide is associated with a high degradation rate and a low half-life.

In some embodiments of any of the aspects, the polypeptide is in combination with a protease inhibitor bound to the repressible protease.

In some embodiments of any of the aspects, the protease inhibitor is selected from grazoprevir (GZV), danoprevir, simeprevir, asunaprevir, ciluprevir, boceprevir, sovaprevir, paritaprevir, ombitasvir, paritaprevir, ritonavir, dasabuvir, and telaprevir.

In some embodiments of any of the aspects, the polypeptide is not degraded when the protease inhibitor is bound to the repressible protease.

In some embodiments of any of the aspects, the polypeptide comprises from the N-terminus to the C-terminus: (a) an extracellular binding domain; (b) a transmembrane domain; (c) a first protease cleavage site; (d) a repressible protease; (e) a second protease cleavage site; and (f) a single intracellular signaling domain.

In some embodiments of any of the aspects, the extracellular binding domain is an antibody, an antigen-binding fragment thereof, a F(ab) fragment, a F(ab') fragment, a single chain variable fragment (scFv), or a single-domain antibody (sdAb).

In some embodiments of any of the aspects, the extracellular binding domain comprises a scFv.

In some embodiments of any of the aspects, the extracellular binding domain specifically binds to a tumor antigen.

In some embodiments of any of the aspects, the transmembrane domain is located between the extracellular binding domain and the intracellular signaling domain.

In some embodiments of any of the aspects, the intracellular signaling domain comprises the intracellular signaling domain selected from TCRC; FcRy; FcRp; CD3zeta; CD3y; CD35; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-Ll); CD278 (ICOS); DAP10; LAT; KD2C SLP76; TRIM; ZAP70; and 41BB.

In some embodiments of any of the aspects, the intracellular signaling domain comprises the intracellular signaling domain of CD3zeta.

In some embodiments of any of the aspects, the polypeptide further comprises a leading peptide located N-terminal to the extracellular binding domain.

In some embodiments of any of the aspects, the leading peptide is a CD8alpha leading peptide.

In some embodiments of any of the aspects, the polypeptide further comprises a spacer domain located between the extracellular binding domain and the transmembrane domain.

In some embodiments of any of the aspects, the spacer domain comprises a CD8 hinge domain.

In some embodiments of any of the aspects, the polypeptide further comprises a first detectable marker adjacent to and C terminal of the extracellular binding domain.

In some embodiments of any of the aspects, the polypeptide further comprises a second detectable marker adjacent and N terminal to the repressible protease.

In some embodiments of any of the aspects, the polypeptide further comprises a third detectable marker adjacent to and C terminal to the repressible protease.

In some embodiments of any of the aspects, the first, second, or third detectable marker is selected from GFP, V5, HA1, Myc, VSV-G, HSV, FLAG, HIS, AU1, mCherry, and biotin.

In some embodiments of any of the aspects, the polypeptide comprises SEQ ID NO: 38 or a sequence that is at least 70% identical to SEQ ID NO: 38 that maintains the same function.

In one aspect described herein is a polypeptide comprising: (a) an extracellular binding domain; (b) a transmembrane domain; (c) at least one intracellular signaling domain; and (d) a degron domain.

In some embodiments of any of the aspects, the degron domain comprises a dihydrofolate reductase (DHFR) degron (DD) or a ligand-induced degradation (LID) domain.

In some embodiments of any of the aspects, the polypeptide is in combination with a degron stabilizer bound to the degron domain.

In some embodiments of any of the aspects, the degron is DHFR degron and the degron stabilizer is trimethoprim (TMP) or an analog thereof.

In some embodiments of any of the aspects, the polypeptide is in combination with a degron destabilizer bound to the degron domain.

In some embodiments of any of the aspects, the degron is a ligand-induced degradation (LID) domain and the degron destabilizer is Shield-1 or an analog thereof.

In some embodiments of any of the aspects, the polypeptide is not degraded when the degron stabilizer is bound to the degron domain.

In some embodiments of any of the aspects, the polypeptide is degraded when the degron destabilizer is bound to the degron domain.

In some embodiments of any of the aspects, the polypeptide comprises from the N-terminus to the C-terminus: (a) an extracellular binding domain; (b) a transmembrane domain; (c) at least one intracellular signaling domain; and (d) a degron domain.

In some embodiments of any of the aspects, the extracellular binding domain is an antibody, an antigen-binding fragment thereof, a F(ab) fragment, a F(ab') fragment, a single chain variable fragment (scFv), or a single-domain antibody (sdAb).

In some embodiments of any of the aspects, the extracellular binding domain comprises a scFv.

In some embodiments of any of the aspects, the extracellular binding domain specifically binds to a tumor antigen.

In some embodiments of any of the aspects, the transmembrane domain is located between the extracellular binding domain and the at least one intracellular signaling domain.

In some embodiments of any of the aspects, each of the at least one intracellular signaling domains independently comprises an intracellular signaling domain selected from the group consisting of: TCRC; FcRy; FcRp; CD3zeta; CD3y; CD35; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-Ll); CD278 (ICOS); DAP10; LAT; KD2C SLP76; TRIM; ZAP70; and 41BB.

In some embodiments of any of the aspects, the intracellular signaling domain comprises the intracellular signaling domain of CD28 and/or 4-1BB.

In some embodiments of any of the aspects, the polypeptide further comprises a leading peptide located N-terminal to the extracellular binding domain.

In some embodiments of any of the aspects, the leading peptide is a CD8alpha leading peptide.

In some embodiments of any of the aspects, the polypeptide further comprises a spacer domain located between the extracellular binding domain and the transmembrane domain.

In some embodiments of any of the aspects, the spacer domain comprises a CD8 hinge domain.

In some embodiments of any of the aspects, the polypeptide further comprises a detectable marker adjacent to and C terminal of the extracellular binding domain.

In some embodiments of any of the aspects, the detectable marker is selected from GFP, V5, HA1, Myc, VSV-G, HSV, FLAG, HIS, AU1, mCherry, and biotin.

In some embodiments of any of the aspects, the polypeptide comprises SEQ ID NO: 39 or a sequence that is at least 70% identical to SEQ ID NO: 39 that maintains the same function.

In one aspect described herein is a system comprising a first polypeptide (e.g., a first AND-gate CAR polypeptide as described herein) and a second polypeptide (e.g., a second AND-gate polypeptide).

In one aspect described herein is a system comprising: (a) a first polypeptide comprising: (i) an extracellular binding domain; (ii) a transmembrane domain; (iii) a repressible protease; and (iv) at least one intracellular signaling domain; and (b) a second polypeptide comprising: (i) an extracellular binding domain; (ii) a transmembrane domain; (iii) at least one intracellular signaling domain; and (iv) a degron domain.

In some embodiments of any of the aspects, the system is functional only in the presence of the protease inhibitor and the degron stabilizer.

In some embodiments of any of the aspects, the system is functional only in the presence of the protease inhibitor and the absence of the degron destabilizer.

In some embodiments of any of the aspects, the first polypeptide comprises a signaling domain.

In some embodiments of any of the aspects, the signaling domain comprises the signaling domain of CD3zeta.

In some embodiments of any of the aspects, the second polypeptide comprises a co-stimulatory signaling domain.

In some embodiments of any of the aspects, the co-stimulatory signaling domain comprises the co-stimulatory signaling domain of CD28 and/or 4-1BB.

In some embodiments of any of the aspects, the first polypeptide and second polypeptide are physically linked to one another.

In some embodiments of any of the aspects, the first polypeptide and second polypeptide flank a self-cleaving peptide domain.

In one aspect described herein is a polypeptide comprising: (a) an extracellular binding domain; (b) a transmembrane domain; and (c) a peptide domain.

In some embodiments of any of the aspects, the peptide domain is specifically bound by a repressible protease.

In some embodiments of any of the aspects, the peptide domain is specifically bound by NS3.

In some embodiments of any of the aspects, the polypeptide comprises from the N-terminus to the C-terminus: (a) an extracellular binding domain; (b) a transmembrane domain; and (c) a peptide domain.

In some embodiments of any of the aspects, the polypeptide comprises from the N-terminus to the C-terminus: (a) an extracellular binding domain; (b) a transmembrane domain; (c) at least one intracellular signaling domain; and (c) a peptide domain.

In some embodiments of any of the aspects, the polypeptide comprises from the N-terminus to the C-terminus: (a) an extracellular binding domain; (b) a transmembrane domain; (c) a single intracellular signaling domain; and (d) a peptide domain.

In some embodiments of any of the aspects, the polypeptide comprises from the N-terminus to the C-terminus: (a) an extracellular binding domain; (b) a transmembrane domain; (c) a first intracellular signaling domain; (d) a second intracellular signaling domain; and (e) a peptide domain.

In some embodiments of any of the aspects, the extracellular binding domain is an antibody, an antigen-binding fragment thereof, a F(ab) fragment, a F(ab') fragment, a single chain variable fragment (scFv), or a single-domain antibody (sdAb).

In some embodiments of any of the aspects, the extracellular binding domain comprises a scFv.

In some embodiments of any of the aspects, the extracellular binding domain specifically binds to a tumor antigen.

In some embodiments of any of the aspects, the transmembrane domain is located between the extracellular binding domain and the peptide domain.

In some embodiments of any of the aspects, the polypeptide further comprises at least one intracellular signaling domain.

In some embodiments of any of the aspects, each of the at least one intracellular signaling domains independently comprises an intracellular signaling domain selected from the group consisting of: TCRC; FcRy; FcRp; CD3zeta; CD3y; CD35; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-L1); CD278 (ICOS); DAP10; LAT; KD2C SLP76; TRIM; ZAP70; and 41BB.

In some embodiments of any of the aspects, the at least one intracellular signaling domain comprises the intracellular signaling domain of CD28 and/or 4-1BB.

In some embodiments of any of the aspects, the polypeptide further comprises a leading peptide located N-terminal to the extracellular binding domain.

In some embodiments of any of the aspects, the leading peptide is a CD8alpha leading peptide.

In some embodiments of any of the aspects, the polypeptide further comprises a spacer domain located between the extracellular binding domain and the transmembrane domain.

In some embodiments of any of the aspects, the spacer domain comprises a CD8 hinge domain.

In some embodiments of any of the aspects, the polypeptide further comprises a detectable marker adjacent to and C terminal of the extracellular binding domain.

In some embodiments of any of the aspects, the detectable marker is selected from GFP, V5, HA1, Myc, VSV-G, HSV, FLAG, HIS, AU1, mCherry, and biotin.

In some embodiments of any of the aspects, the polypeptide comprises SEQ ID NO: 84, SEQ ID NO: 85, or a sequence that is at least 70% identical to SEQ ID NO: 84 or SEQ ID NO: 85 that maintains the same function.

In one aspect described herein is a polypeptide comprising: (a) an extracellular domain; (b) a transmembrane domain; (c) a repressible protease; and (d) at least one intracellular signaling domain.

In some embodiments of any of the aspects, the repressible protease is hepatitis C virus (HCV) nonstructural protein 3 (NS3).

In some embodiments of any of the aspects, the NS3 is catalytically dead.

In some embodiments of any of the aspects, the polypeptide does not comprise any protease cleavage sites.

In some embodiments of any of the aspects, the repressible protease is located: (a) between the transmembrane domain and the at least one intracellular signaling domain; (b) between the first intracellular signaling domain and the second intracellular signaling domain; or (c) at the C terminus of the polypeptide.

In some embodiments of any of the aspects, the polypeptide is in combination with a protease inhibitor bound to the repressible protease.

In some embodiments of any of the aspects, the protease inhibitor is selected from grazoprevir (GZV), danoprevir, simeprevir, asunaprevir, ciluprevir, boceprevir, sovaprevir, paritaprevir, ombitasvir, paritaprevir, ritonavir, dasabuvir, and telaprevir.

In some embodiments of any of the aspects, the polypeptide further comprises a cofactor for the repressible protease.

In some embodiments of any of the aspects, the cofactor is an HSV NS4A domain.

In some embodiments of any of the aspects, the HSV NS4A domain is adjacent and N-terminal to the repressible protease.

In some embodiments of any of the aspects, the polypeptide comprises from the N-terminus to the C-terminus: (a) an extracellular domain; (b) a transmembrane domain; (c) at least one intracellular signaling domain; (d) a repressible protease; and (e) at least one intracellular signaling domain.

In some embodiments of any of the aspects, the polypeptide comprises from the N-terminus to the C-terminus: (a) an extracellular domain; (b) a transmembrane domain; (c) a first intracellular signaling domain; (d) a repressible protease; and (e) a second intracellular signaling domain.

In some embodiments of any of the aspects, the polypeptide comprises from the N-terminus to the C-terminus: (a) an extracellular domain; (b) a transmembrane domain; (c) at least one intracellular signaling domain; and (d) a repressible protease.

In some embodiments of any of the aspects, the polypeptide comprises from the N-terminus to the C-terminus: (a) an extracellular domain; (b) a transmembrane domain; (c) a first intracellular signaling domain; (d) a second intracellular signaling domain; and (e) a repressible protease.

In some embodiments of any of the aspects, the polypeptide comprises from the N-terminus to the C-terminus: (a) an extracellular domain; (b) a transmembrane domain; (c) a single intracellular signaling domain; and (d) a repressible protease.

In some embodiments of any of the aspects, the polypeptide comprises from the N-terminus to the C-terminus: (a) an extracellular domain; (b) a transmembrane domain; (d) a repressible protease; and (e) at least one intracellular signaling domain.

In some embodiments of any of the aspects, the polypeptide comprises from the N-terminus to the C-terminus: (a) an extracellular domain; (b) a transmembrane domain; (c) a repressible protease; and (d) a single intracellular signaling domain.

In some embodiments of any of the aspects, the extracellular domain comprises the extracellular domain of DAP10.

In some embodiments of any of the aspects, the transmembrane domain comprises the transmembrane domain of CD8.

In some embodiments of any of the aspects, each of the at least one intracellular signaling domains independently comprises an intracellular signaling domain selected from the group consisting of: TCRC; FcRy; FcRp; CD3zeta; CD3y; CD35; CD3s; CD3C; CD22; CD79a; CD79b; CD66d; CARD 11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-L1); CD278 (ICOS); DAP10; LAT; KD2C SLP76; TRIM; ZAP70; and 41BB.

In some embodiments of any of the aspects, the at least one intracellular signaling domain comprises the intracellular signaling domain of 4-1BB and/or CD3zeta.

In some embodiments of any of the aspects, the polypeptide further comprises at least one detectable marker at the C-terminal end of the polypeptide.

In some embodiments of any of the aspects, the detectable marker is selected from GFP, V5, HA1, Myc, VSV-G, HSV, FLAG, HIS, AU1, mCherry, and biotin.

In some embodiments of any of the aspects, the polypeptide comprises one of SEQ ID NOs: 86-89 or a sequence that is at least 70% identical to one of SEQ ID NOs: 86-89 that maintains the same function.

In one aspect described herein is a system comprising a first polypeptide (e.g., a first OFF-switch CAR polypeptide as described herein) and a second polypeptide (e.g., a second OFF-switch CAR polypeptide as described herein).

In one aspect described herein is a system comprising: (a) a first polypeptide comprising: (i) an extracellular binding domain; (ii) a transmembrane domain; and (iii) a peptide domain; and (b) a second polypeptide comprising: (i) an extracellular domain; (ii) a transmembrane domain; (iii) a repressible protease; and (iv) at least one intracellular signaling domain.

In some embodiments of any of the aspects, the second polypeptide specifically binds to the first polypeptide.

In some embodiments of any of the aspects, the system is in combination with a protease inhibitor bound to the repressible protease of the second polypeptide.

In some embodiments of any of the aspects, the protease inhibitor is selected from grazoprevir (GZV), danoprevir, simeprevir, asunaprevir, ciluprevir, boceprevir, sovaprevir, paritaprevir, ombitasvir, paritaprevir, ritonavir, dasabuvir, and telaprevir.

In some embodiments of any of the aspects, the second polypeptide does not specifically bind the first polypeptide in the presence of the protease inhibitor.

In some embodiments of any of the aspects, the first polypeptide comprises a co-stimulatory signaling domain.

In some embodiments of any of the aspects, the co-stimulatory signaling domain comprises the co-stimulatory signaling domain of CD28 and/or 4-1BB.

In some embodiments of any of the aspects, the second polypeptide comprises a signaling domain.

In some embodiments of any of the aspects, the signaling domain comprises the signaling domain of CD3zeta.

In some embodiments of any of the aspects, the first polypeptide and second polypeptide are physically linked to one another.

In some embodiments of any of the aspects, the first polypeptide and second polypeptide flank a self-cleaving peptide domain.

In some embodiments of any of the aspects, the system comprises one of SEQ ID NOs: 114-121 or a sequence that is at least 70% identical to one of SEQ ID NOs: 114-121 that maintains the same function.

In one aspect described herein is a polypeptide comprising: (a) an extracellular binding domain; (b) a transmembrane domain; and (c) a reader domain.

In some embodiments of any of the aspects, the reader domain specifically binds to a repressible protease in the presence of a specific protease inhibitor.

In some embodiments of any of the aspects, the reader domain is a danoprevir/NS3 complex reader domain (DNCR) or a grazoprevir/NS3 reader complex (GNCR) domain.

In some embodiments of any of the aspects, the polypeptide comprises from the N-terminus to the C-terminus: (a) an extracellular binding domain; (b) a transmembrane domain; (c) a first intracellular signaling domain; (d) a second intracellular signaling domain; and (e) a reader domain.

In some embodiments of any of the aspects, the polypeptide comprises from the N-terminus to the C-terminus: (a) an extracellular binding domain; (b) a transmembrane domain; (c) a single intracellular signaling domain; and (d) and a reader domain.

In some embodiments of any of the aspects, the polypeptide further comprises at least one intracellular signaling domain.

In some embodiments of any of the aspects, each of the at least one intracellular signaling domains independently comprises an intracellular signaling domain selected from the group consisting of: TCRC; FcRy; FcRp; CD3zeta; CD3y; CD3δ; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-L1); CD278 (ICOS); DAP10; LAT; KD2C SLP76; TRIM; ZAP70; and 41BB.

In some embodiments of any of the aspects, the at least one intracellular signaling domain comprises an intracellular signaling domain of CD28, and/or 4-1BB.

In some embodiments of any of the aspects, the transmembrane domain is located between the extracellular binding domain and the at least one intracellular signaling domain.

In some embodiments of any of the aspects, the transmembrane domain comprises the transmembrane domain of CD28.

In some embodiments of any of the aspects, the extracellular binding domain is an antibody, an antigen-binding fragment thereof, a F(ab) fragment, a F(ab') fragment, a single chain variable fragment (scFv), or a single-domain antibody (sdAb).

In some embodiments of any of the aspects, the extracellular binding domain comprises a scFv.

In some embodiments of any of the aspects, the extracellular binding domain specifically binds to a tumor antigen.

In some embodiments of any of the aspects, the polypeptide further comprises a leading peptide located N-terminal to the extracellular binding domain.

In some embodiments of any of the aspects, the leading peptide is a CD8alpha leading peptide.

In some embodiments of any of the aspects, the polypeptide further comprises a spacer domain located between the extracellular binding domain and the transmembrane domain.

In some embodiments of any of the aspects, the spacer domain comprises a CD8 hinge domain.

In some embodiments of any of the aspects, the polypeptide further comprises a detectable marker adjacent to and C terminal of the extracellular binding domain.

In some embodiments of any of the aspects, the detectable marker is selected from GFP, V5, HA1, Myc, VSV-G, HSV, FLAG, HIS, and biotin.

In some embodiments of any of the aspects, the polypeptide comprises residues 1-626 of SEQ ID NO: 90, residues 1-668 of SEQ ID NO: 91, residues 1-630 of SEQ ID NO: 92, residues 1-672 of SEQ ID NO: 93, residues 1-626 of SEQ ID NO: 127, residues 1-630 of SEQ ID NO: 128, or a sequence that is at least 70% identical to residues 1-626 of SEQ ID NO: 90, residues 1-668 of SEQ ID NO: 91, residues 1-630 of SEQ ID NO: 92, residues 1-672 of SEQ ID NO: 93, residues 1-626 of SEQ ID NO: 127, or residues 1-630 of SEQ ID NO: 128, that maintains the same function.

In one aspect described herein is a polypeptide comprising: (a) a repressible protease; and (b) at least one intracellular signaling domain.

In some embodiments of any of the aspects, the repressible protease is hepatitis C virus (HCV) nonstructural protein 3 (NS3).

In some embodiments of any of the aspects, the NS3 is catalytically dead.

In some embodiments of any of the aspects, the polypeptide does not comprise any protease cleavage sites.

In some embodiments of any of the aspects, the polypeptide further comprises a cofactor for the repressible protease.

In some embodiments of any of the aspects, the cofactor is an HSV NS4A domain.

In some embodiments of any of the aspects, the HSV NS4A domain is adjacent and N-terminal to the repressible protease.

In some embodiments of any of the aspects, the polypeptide is in combination with a protease inhibitor bound to the repressible protease.

In some embodiments of any of the aspects, the protease inhibitor is selected from grazoprevir (GZV), danoprevir, simeprevir, asunaprevir, ciluprevir, boceprevir, sovaprevir, paritaprevir, ombitasvir, paritaprevir, ritonavir, dasabuvir, and telaprevir.

In some embodiments of any of the aspects, the polypeptide comprises from the N-terminus to the C-terminus: (a) an extracellular domain; (b) a transmembrane domain; (c) at least one intracellular signaling domain; (d) a repressible protease; and (e) at least one intracellular signaling domain.

In some embodiments of any of the aspects, the polypeptide comprises from the N-terminus to the C-terminus: (a) an extracellular domain; (c) a transmembrane domain; (d) a first intracellular signaling domain; (e) a repressible protease; and (f) a second intracellular signaling domain.

In some embodiments of any of the aspects, the polypeptide further comprises an extracellular domain and a transmembrane domain.

In some embodiments of any of the aspects, the extracellular domain comprises the extracellular domain of DAP10.

In some embodiments of any of the aspects, the transmembrane domain comprises the transmembrane domain of CD8.

In some embodiments of any of the aspects, each of the at least one intracellular signaling domains independently comprises an intracellular signaling domain selected from the group consisting of: TCRC; FcRy; FcRp; CD3zeta; CD3y; CD3δ; CD3s; CD3C; CD22; CD79a; CD79b; CD66d; CARD11; CD2; CD7; CD27; CD28; CD30; CD40;

CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-L1); CD278 (ICOS); DAP10; LAT; KD2C SLP76; TRIM; ZAP70; and 41BB.

In some embodiments of any of the aspects, the intracellular signaling domain is the intracellular signaling domain of 4-1BB and/or CD3zeta.

In some embodiments of any of the aspects, the polypeptide further comprise at least one detectable marker at the C-terminal end of the polypeptide.

In some embodiments of any of the aspects, the detectable marker is selected from GFP, V5, HA1, Myc, VSV-G, HSV, FLAG, HIS, AU1, mCherry, and biotin.

In some embodiments of any of the aspects, the polypeptide comprises one of SEQ ID NO: 86-89 or residues 648-1313 of SEQ ID NO: 90, residues 690-1355 of SEQ ID NO: 91, residues 652-1317 of SEQ ID NO: 92, residues 694-1359 of SEQ ID NO: 93, residues 648-1303 of SEQ ID NO: 127, or residues 652-1307 of SEQ ID NO: 128, or a sequence that is at least 70% identical to one of SEQ ID NO: 86-89 or residues 648-1313 of SEQ ID NO: 90, residues 690-1355 of SEQ ID NO: 91, residues 652-1317 of SEQ ID NO: 92, residues 694-1359 of SEQ ID NO: 93, residues 648-1303 of SEQ ID NO: 127, or residues 652-1307 of SEQ ID NO: 128 that maintains the same function.

In one aspect described herein is a system comprising a first polypeptide (e.g., a first reader CAR polypeptide as described herein) and a second polypeptide (e.g., a second reader CAR polypeptide as described herein).

In one aspect described herein is a system comprising: (a) a first polypeptide comprising: (i) an extracellular binding domain; (ii) a transmembrane domain; and (c) a reader domain; and (b) a second polypeptide comprising: (i) a repressible protease; and (ii) at least one intracellular signaling domain.

In some embodiments of any of the aspects, the system is in combination with a protease inhibitor bound to the repressible protease of the second polypeptide.

In some embodiments of any of the aspects, the protease inhibitor is selected from grazoprevir (GZV), danoprevir, simeprevir, asunaprevir, ciluprevir, boceprevir, sovaprevir, paritaprevir, ombitasvir, paritaprevir, ritonavir, dasabuvir, and telaprevir.

In some embodiments of any of the aspects, the reader domain of the first polypeptide specifically binds to the repressible protease of the second polypeptide in the presence of a protease inhibitor; and/or the reader domain of the first polypeptide does not specifically bind to the repressible protease of the second polypeptide in the absence of the protease inhibitor specific to the reader domain.

In some embodiments of any of the aspects, the first polypeptide comprises a co-stimulatory signaling domain.

In some embodiments of any of the aspects, the co-stimulatory signaling domain comprises the co-stimulatory signaling domain of CD28 and/or 4-1BB.

In some embodiments of any of the aspects, the second polypeptide comprises a signaling domain.

In some embodiments of any of the aspects, the signaling domain comprises the signaling domain of CD3zeta.

In some embodiments of any of the aspects, the first polypeptide and second polypeptide are physically linked to one another.

In some embodiments of any of the aspects, the first polypeptide and second polypeptide flank a self-cleaving peptide domain.

In some embodiments of any of the aspects, the polypeptide comprises SEQ ID NOs: 89-93 or 127-128 or a sequence that is at least 70% identical to SEQ ID NOs: 89-93 or 127-128 that maintains the same function.

In one aspect described herein is a polynucleotide encoding a polypeptide or system a described herein.

In some embodiments of any of the aspects, the polynucleotide comprises one of SEQ ID NOs: 1-6, 60-69, 106-113, 125-126, or a sequence that is at least 70% identical to one of SEQ ID NOs: 1-6, 60-69, 106-113, 125-126 that maintains the same function.

In one aspect described herein is a vector comprising a polynucleotide as described herein.

In some embodiments of any of the aspects, the vector comprises one of SEQ ID NOs: 236-261 or a sequence that is at least 70% identical to one of SEQ ID NOs: 236-261 that maintains the same function.

In one aspect described herein is a cell or population thereof comprising a polypeptide or system as described herein, a polynucleotide as described herein, or a vector as described herein.

In some embodiments of any of the aspects, the cell comprises an immune cell.

In some embodiments of any of the aspects, the immune cell comprises a CD4+ T cell, a CD8+ T cell, a regulatory T cell (Treg), or a natural killer (NK) cell.

In some embodiments of any of the aspects, the cell is a CD4+ T cell comprising a polypeptide as described herein.

In some embodiments of any of the aspects, the cell is a CD8+ T cell comprising a polypeptide as described herein.

In some embodiments of any of the aspects, the cell is a Treg comprising a polypeptide as described herein.

In some embodiments of any of the aspects, the cell is an NK cell comprising a polypeptide as described herein.

In some embodiments of any of the aspects, the cell further comprises an inactivating modification of at least one HLA Class I gene in the cell.

In one aspect described herein is a pharmaceutical composition comprising a polypeptide or system as described herein, a polynucleotide as described herein, a vector as described herein, or a cell as described herein, and a pharmaceutically acceptable carrier.

In one aspect described herein is a method of decreasing the degradation of a polypeptide, comprising the steps of: (a) providing a population of cells comprising a polypeptide as described herein (e.g., an ON-switch CAR polypeptide as described herein); and (b) contacting the population of cells with an effective amount of a protease inhibitor.

In some embodiments of any of the aspects, the degradation is decreased by at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the protease inhibitor.

In some embodiments of any of the aspects, the decrease in degradation results in an increase of activity of the polypeptide of at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the protease inhibitor.

In some embodiments of any of the aspects, the increase of activity of the polypeptide comprises an increase in intracellular signaling of the intracellular signaling domains of the polypeptide.

In some embodiments of any of the aspects, the increase in intracellular signaling results in an increase of activation of the population of cells.

In some embodiments of any of the aspects, the activation of the population of cells comprises expression of activation markers comprising CD69 and/or expression of cytokines comprising IL-2 and IFNg.

In some embodiments of any of the aspects, an increase of activation of the population of cells results in an increased killing efficiency of a target cell.

In some embodiments of any of the aspects, the population of cells comprises immune cells.

In some embodiments of any of the aspects, the population of immune cells comprises CD4+ T cells, CD8+ T cells, Tregs, or NK cells.

In some embodiments of any of the aspects, the target cell expresses an antigen that binds to the extracellular binding domain of the polypeptide.

In one aspect described herein is a method of treating a subject in need of a cell-based therapy comprising the steps of: (a) administering to the subject a population of cells comprising a polypeptide as described herein (e.g., an ON-switch CAR polypeptide as described herein); and (b) administering to the subject an effective amount of a protease inhibitor.

In some embodiments of any of the aspects, the protease inhibitor is administered at the same time the population of cells is administered.

In some embodiments of any of the aspects, the protease inhibitor is administered after the population of cells is administered.

In some embodiments of any of the aspects, a withdrawal or decrease in concentration of the protease inhibitor results in increased degradation of the polypeptide.

In some embodiments of any of the aspects, a withdrawal or decrease in concentration of the protease inhibitor results in decreased activity of the polypeptide.

In some embodiments of any of the aspects, the subject has a cancer expressing an antigen that binds to the extracellular binding domain of the polypeptide.

In one aspect described herein is a method of decreasing the degradation of a polypeptide, comprising the steps of: (a) providing a population of cells comprising a polypeptide or system as described herein (e.g., an AND-gate CAR polypeptide system); and (b) contacting the population of cells with an effective amount of a protease inhibitor and/or an effective amount of a degron stabilizer.

In some embodiments of any of the aspects, the degron is DHFR degron and the degron stabilizer is trimethoprim (TMP) or an analog thereof.

In some embodiments of any of the aspects, the degradation is decreased by at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the protease inhibitor and/or degron stabilizer.

In some embodiments of any of the aspects, the decrease in degradation results in an increase of activity of the polypeptide of at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the protease inhibitor and/or degron stabilizer.

In some embodiments of any of the aspects, the increase of activity of the polypeptide comprises an increase in intracellular signaling of the intracellular signaling domains of the polypeptide.

In some embodiments of any of the aspects, the increase in intracellular signaling results in an increase of activation of the population of cells.

In some embodiments of any of the aspects, the activation of the population of cells comprises expression of activation markers comprising CD69 and/or expression of cytokines comprising IL-2 and IFNg.

In some embodiments of any of the aspects, an increase of activation of the population of cells results in an increased killing efficiency of a target cell.

In some embodiments of any of the aspects, the population of cells comprises immune cells.

In some embodiments of any of the aspects, the population of immune cells comprises CD4+ T cells, CD8+ T cells, Tregs, or NK cells.

In some embodiments of any of the aspects, the target cell expresses an antigen that binds to the extracellular binding domain of the first polypeptide of the system and an antigen that binds to the extracellular binding domain of the second polypeptide of the system.

In one aspect described herein is a method of treating a subject in need of a cell-based therapy comprising the steps of: (a) administering to the subject a population of cells comprising a polypeptide or system as described herein (e.g., an AND-gate CAR polypeptide system); and (b) administering to the subject an effective amount of a protease inhibitor and/or an effective amount of a degron stabilizer.

In some embodiments of any of the aspects, the degron is DHFR degron and the degron stabilizer is trimethoprim (TMP) or an analog thereof.

In some embodiments of any of the aspects, the protease inhibitor and/or degron stabilizer is administered at the same time the population of cells is administered.

In some embodiments of any of the aspects, the protease inhibitor and/or degron stabilizer is administered after the population of cells is administered.

In some embodiments of any of the aspects, a withdrawal or decrease in concentration of the protease inhibitor and/or degron stabilizer results in increased degradation of the polypeptide.

In some embodiments of any of the aspects, a withdrawal or decrease in concentration of the protease inhibitor and/or degron stabilizer results in decreased activity of the polypeptide.

In some embodiments of any of the aspects, the subject has a cancer expressing an antigen that binds to the extracellular binding domain of the first polypeptide of the system and an antigen that binds to the extracellular binding domain of the second polypeptide of the system.

In one aspect described herein is a method of modulating the degradation of a polypeptide system, comprising the steps of: (a) providing a population of cells comprising a polypeptide or system as described herein (e.g., an AND-gate CAR polypeptide system); (b) contacting the population of cells with an effective amount of a protease inhibitor to decrease the degradation of the polypeptide system; and (c) contacting the population of cells with an effective amount of a degron destabilizer to increase the degradation of the polypeptide system.

In some embodiments of any of the aspects, the degron is a ligand-induced degradation (LID) domain and the degron destabilizer is Shield-1 or an analog thereof.

In some embodiments of any of the aspects, the degradation is decreased by at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the protease inhibitor.

In some embodiments of any of the aspects, the decrease in degradation results in an increase of activity of the polypeptide of at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the protease inhibitor.

In some embodiments of any of the aspects, the increase of activity of the polypeptide comprises an increase in intracellular signaling of the intracellular signaling domains of the polypeptide.

In some embodiments of any of the aspects, the increase in intracellular signaling results in an increase of activation of the population of cells.

In some embodiments of any of the aspects, the activation of the population of cells comprises expression of activation markers comprising CD69 and/or expression of cytokines comprising IL-2 and IFNg.

In some embodiments of any of the aspects, an increase of activation of the population of cells results in an increased killing efficiency of a target cell.

In some embodiments of any of the aspects, the degradation is increased by at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the degron destabilizer.

In some embodiments of any of the aspects, the increase in degradation results in a decrease of activity of the polypeptide of at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the degron destabilizer.

In some embodiments of any of the aspects, the decrease of activity of the polypeptide system comprises a decrease in intracellular signaling of the intracellular signaling domains of the polypeptide system.

In some embodiments of any of the aspects, the decrease in intracellular signaling results in a decrease of activation of the population of cells.

In some embodiments of any of the aspects, the activation of the population of cells comprises expression of activation markers comprising CD69 and/or expression of cytokines comprising IL-2 and IFNg.

In some embodiments of any of the aspects, a decrease of activation of the population of cells results in a decreased killing efficiency of a target cell.

In some embodiments of any of the aspects, the population of cells comprises immune cells.

In some embodiments of any of the aspects, the population of immune cells comprises CD4+ T cells, CD8+ T cells, Tregs, or NK cells.

In some embodiments of any of the aspects, the target cell expresses an antigen that binds to the extracellular binding domain of the first polypeptide of the system and an antigen that binds to the extracellular binding domain of the second polypeptide of the system.

In one aspect described herein is a method of treating a subject in need of a cell-based therapy comprising the steps of: (a) administering to the subject a population of cells comprising a polypeptide or system as described herein (e.g., an AND-gate CAR polypeptide system); (b) administering to the subject an effective amount of a protease inhibitor; and (c) administering to the subject an effective amount of a degron destabilizer.

In some embodiments of any of the aspects, the degron is a ligand-induced degradation (LID) domain and the degron destabilizer is Shield-1 or an analog thereof.

In some embodiments of any of the aspects, the protease inhibitor is administered at the same time the population of cells is administered.

In some embodiments of any of the aspects, the protease inhibitor is administered after the population of cells is administered.

In some embodiments of any of the aspects, the degron destabilizer is administered after the population of cells is administered.

In some embodiments of any of the aspects, an increase in concentration of the protease inhibitor results in increased activity of the polypeptide system.

In some embodiments of any of the aspects, an increase in concentration of the degron destabilizer results in decreased activity of the polypeptide system.

In some embodiments of any of the aspects, the subject has a cancer expressing an antigen that binds to the extracellular binding domain of the first polypeptide of the system and an antigen that binds to the extracellular binding domain of the second polypeptide of the system.

In one aspect described herein is a method of decreasing the activity of a polypeptide system, comprising the steps of: (a) providing a population of cells comprising a polypeptide or system as described herein (e.g., an OFF-switch CAR polypeptide system); and (b) contacting the population of cells with an effective amount of a protease inhibitor.

In some embodiments of any of the aspects, the activity is decreased by at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the protease inhibitor.

In some embodiments of any of the aspects, the decrease of activity of the polypeptide system comprises a decrease in intracellular signaling of the intracellular signaling domains of the polypeptide system.

In some embodiments of any of the aspects, the decrease in intracellular signaling results in a decrease of activation of the population of cells.

In some embodiments of any of the aspects, the activation of the population of cells comprises expression of activation markers comprising CD69 and/or expression of cytokines comprising IL-2 and IFNg.

In some embodiments of any of the aspects, a decrease of activation of the population of cells results in a decreased killing efficiency of a target cell.

In some embodiments of any of the aspects, the population of cells comprises immune cells.

In some embodiments of any of the aspects, the population of immune cells comprises CD4+ T cells, CD8+ T cells, Tregs, or NK cells.

In some embodiments of any of the aspects, the target cell expresses an antigen that binds to the extracellular binding domain of the first polypeptide of the system.

In one aspect described herein is a method of treating a subject in need of a cell-based therapy comprising the steps of: (a) administering to the subject a population of cells comprising a polypeptide or system as described herein (e.g., an OFF-switch CAR polypeptide system); and (b) administering to the subject an effective amount of a protease inhibitor.

In some embodiments of any of the aspects, the protease inhibitor is administered at the same time the population of cells is administered.

In some embodiments of any of the aspects, the protease inhibitor is administered after the population of cells is administered.

In some embodiments of any of the aspects, an increase in concentration of the protease inhibitor results in decreased activity of the polypeptide system.

In some embodiments of any of the aspects, the subject has a cancer expressing an antigen that binds to the extracellular binding domain of the polypeptide.

In one aspect described herein is a method of increasing the activity of a polypeptide system, comprising the steps of: (a) providing a population of cells comprising a polypeptide or system as described herein (e.g., a reader CAR polypeptide system); and (b) contacting the population of cells with an effective amount of a protease inhibitor.

In some embodiments of any of the aspects, the activity is increased by at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the protease inhibitor.

In some embodiments of any of the aspects, the increase of activity of the polypeptide system comprises an increase in intracellular signaling of the intracellular signaling domains of the polypeptide system.

In some embodiments of any of the aspects, the increase in intracellular signaling results in an increase of activation of the population of cells.

In some embodiments of any of the aspects, the activation of the population of cells comprises expression of activation markers comprising CD69 and/or expression of cytokines comprising IL-2 and IFNg.

In some embodiments of any of the aspects, an increase of activation of the population of cells results in an increased killing efficiency of a target cell.

In some embodiments of any of the aspects, the population of cells comprises immune cells.

In some embodiments of any of the aspects, the population of immune cells comprises CD4+ T cells, CD8+ T cells, Tregs, or NK cells.

In some embodiments of any of the aspects, the target cell expresses an antigen that binds to the extracellular binding domain of the first polypeptide of the system.

In one aspect described herein is a method of treating a subject in need of a cell-based therapy comprising the steps of: (a) administering to the subject a population of cells comprising a polypeptide or system as described herein (e.g., a reader CAR polypeptide system); and (b) administering to the subject an effective amount of a protease inhibitor.

In some embodiments of any of the aspects, the protease inhibitor is administered at the same time the population of cells is administered.

In some embodiments of any of the aspects, the protease inhibitor is administered after the population of cells is administered.

In some embodiments of any of the aspects, an increase in concentration of the protease inhibitor results in increased activity of the polypeptide system.

In some embodiments of any of the aspects, the subject has a cancer expressing an antigen that binds to the extracellular binding domain of the polypeptide.

BRIEF DESCRIPTION OF THE DRAWINGS

FIG. 1A shows three versions of the NS3 CAR construct compared to traditional CAR. FIG. 1B shows the mechanism of action of the NS3 CAR.

FIG. 2A is a series of bar graphs showing CD69 expression in CD4+ and CD8+ T cells following expression of the NS3 CAR constructs or traditional CAR, in the presence or absence of GZV (Grazoprevir) and/or target cell. FIG. 2B is a series of bar graphs showing CD4+ and CD8+ T cell IL-2 and IFN-gamma cytokine release following expression the NS3 CAR constructs or traditional CAR, in the presence or absence of GZV and/or target cell.

FIG. 3A is a bar graph showing the killing efficiency of CD8+ T cells following expression of the NS3 CAR constructs or traditional CAR, in the presence or absence of GZV. FIG. 3B is a line graph showing that the concentration of Grazoprevir can be used to regulate the level of killing efficiency by CD8+ T cells expressing NS3 CAR (V2) but does not impact traditional CAR T cells or wild-type cells.

FIG. 4B is a series of flow cytometry histograms showing CD69 expression in WT Tregs (solid lines) or Tregs expressing the indicated CAR construct (dashed lines) without GZV (left graphs) or with 1 uM GZV (right graphs). The bar graph of FIG. 4B shows CD69 expression in WT Tregs or Tregs expressing NS3 CAR constructs or traditional CAR without GZV (dark grey) or with 1 uM GZV (light grey). FIG. 4C is a schematic and a series of flow cytometry histograms showing CD4+ T cell proliferation induced by T regs expressing NS3 CAR constructs or traditional CAR with or without 1 uM GZV.

FIG. 5A is a bar graph showing the killing efficiency of NK cells expressing NS3 CARs or traditional CAR with or without GZV. FIG. 5B is a series of flow cytometry histograms showing the levels of NS3 CAR or traditional CAR expression in natural killer (NK) cells. FIG. 5C is a series of bar graphs showing the level of IFN-gamma release in NK cells expressing NS3 CARs or traditional CAR with or without GZV.

FIG. 6A has a schematic showing the structure of the AND gate CAR construct. FIG. 6A also shows a series of flow cytometry dot plots showing the expression of ScFv1 and ScFv2 of the AND gate CAR construct on CD4+ or CD8+ T cells in the presence or absence of trimethoprim (TMP) and/or GZV. FIG. 6B is a series of bar graphs showing the expression of CD69, IFN, and IL-2 in CD4+ T cells expressing the AND gate construct in the presence or absence of trimethoprim (TMP) and/or GZV; the heat maps show the effect of varying the amount of trimethoprim (TMP) and/or GZV on the expression of CD69, IFN, and IL-2 in CD4+ T cells expressing the AND gate construct. FIG. 6C is a bar graph showing the percentage of remaining viable (target) cells of CD8+ T cells expressing the AND gate construct in the presence or absence of trimethoprim (TMP) and/or GZV.

FIG. 8A shows a schematic for how the NS3 OFF CAR functions. FIG. 8B shows various designs tested for the first and second components that make up the NS3 OFF CAR. Combinations of components were tested as indicated. Each was introduced on a separate vector. FIG. 8C shows NFAT activity of Jurkat cells expressing different versions of the OFF CAR in the presence and absence of grazoprevir. FIG. 8D shows levels of T cell activation marker CD69 in Jurkat cells expressing the variations of the OFF CAR.

FIG. 9A-9C is a series of schematics and graphs showing testing of NS3 OFF switch CAR in Jurkat T cells with components introduced in a single vector. FIG. 9A is a diagram of how the components are located on the single vector. FIG. 9B is a bar graph showing NFAT levels of Jurkat cells expressing the OFF CAR. FIG. 9C is a bar graph showing CD69 activation marker levels for Jurkat cells expressing different versions of the OFF CAR.

FIG. 10A is a diagram of how the components are located on the single vector. FIG. 10B is a bar graph showing cytotoxicity of T cells expressing the OFF CAR. FIG. 10C-10D are bar graphs showing cytokine levels released by primary T cells expressing the different versions of the OFF CAR. FIG. 10C shows IFN levels, and FIG. 10D shows IL-2 levels.

FIG. 11A is a diagram of how the components are located on the single vector. FIG. 11B is a bar graph showing NFAT activity of Jurkat cells expressing reader CARs comprising the NS31a genotype. FIG. 11C is a bar graph showing NFAT activity of Jurkat cells expressing reader CARs comprising the NS31b genotype. For FIG. 11B-11C, danoprevir is indicated in light grey, and grazoprevir is indicated in dark grey.

FIG. 12A shows a schematic for how the DNCR and GNCR reader CARs function. FIG. 12B is a schematic and series of graphs showing the functionality of Jurkat T cells expressing the reader CARs. The reader CAR versions tested in FIG. 12B included CD28 in the first component and 4-1BB in the second component. FIG. 12C is a schematic and series of graphs showing additional versions of the reader CARs tested, which included both CD28 and 4-1BB in the first component, and 4-1BB again in the second component. In the top panel flow cytometry plots of FIGS. 12B and 12C, the dark grey curve indicates WT cells, and the light grey curve indicates cells transduced with the indicated CAR construct. In the bottom panel bar graphs of FIGS. 12B and 12C, the light grey bar indicates that the highest functionality in cells expressing a DNCR CAR system occurs when contacted with danoprevir; and the dark grey bar indicates that the highest functionality in cells expressing a GNCR CAR system occurs when contacted with grazoprevir.

DETAILED DESCRIPTION

Figure 1A:
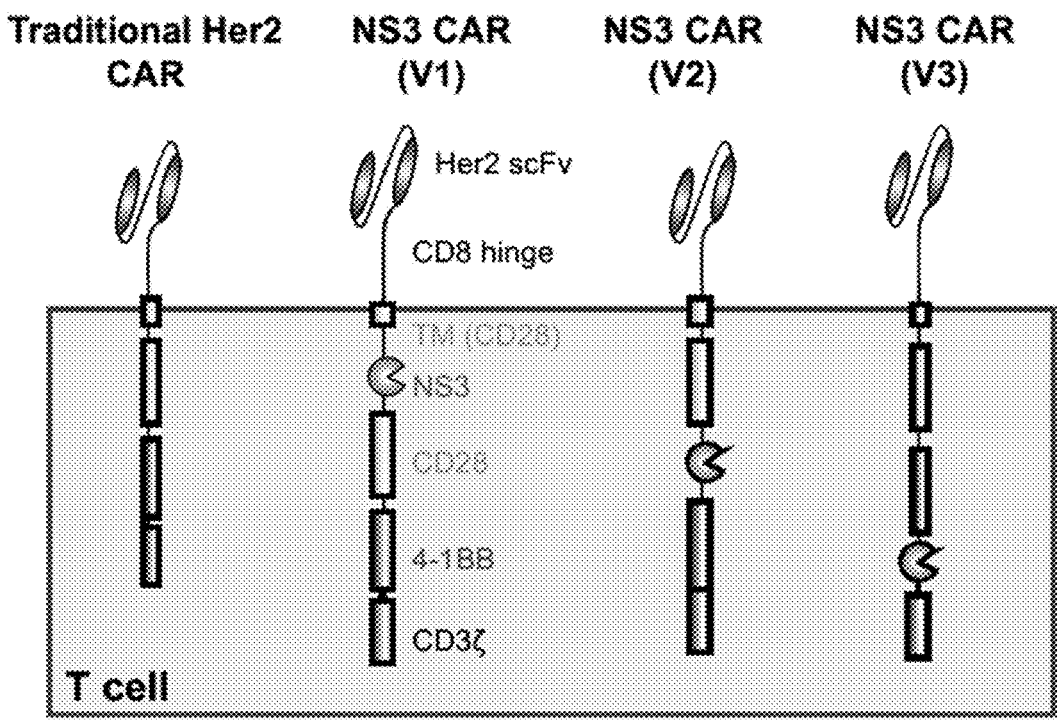
FIG. 1A-1B is a series of schematics.

Described herein are four general frameworks of drug-controllable CAR polypeptides and systems comprising repressible proteases: (1) drug-inducible CAR polypeptides (i.e., ON-switches); (2) drug-inducible two-component logic-switch CAR polypeptide systems (i.e., AND-gates); (3) drug-repressible CAR polypeptide systems (i.e., OFF-switches); and (4) drug-inducible reader CAR polypeptide systems that are responsive to a specific protease inhibitor (i.e., reader CARs). Also described herein are polynucleotides and vector encoding said CAR polypeptides, cells expressing said CAR polypeptides, pharmaceutical compositions comprising said CAR polypeptides, and methods of using said CAR polypeptides.

In multiple aspects described herein are polypeptides that are drug-inducible (i.e., ON-switch) or drug-repressible (i.e., OFF-switch) chimeric antigen receptors (CARs, also known as chimeric immunoreceptors). CARs are receptor proteins that have been engineered to give cells, such as T cells, the ability to target a specific protein. The receptors are chimeric because they combine both antigen-binding and immune cell activating functions into a single receptor.

T cells naturally express T-cell receptor (TCR) and a variety of co-stimulatory receptors and signaling molecules. The TCR is responsible for recognizing fragments of antigen as peptides bound to major histocompatibility complex (MHC) molecules. In humans, in 95% of T cells the TCR consists of an alpha (a) chain and a beta (13) chain (encoded by TRA and TRB, respectively), whereas in 5% of T cells the TCR consists of gamma and delta ($\gamma/\delta$) chains (encoded by TRG and TRD, respectively). The T cell receptor exists as a complex of several proteins. The actual T cell receptor is composed of two separate peptide chains (e.g., TCR$\alpha$ and TCR$\beta$). The other proteins in the complex are the CD3 proteins: CD3$\epsilon\gamma$ and CD3$\epsilon\delta$ heterodimers and, most important, a CD3$\zeta$ homodimer, which has a total of six immunoreceptor tyrosine-based activation motif (ITAM) motifs.

Activation of CD4+ T cells occurs through the simultaneous engagement of the T-cell receptor and a co-stimulatory molecule (e.g., CD28, or ICOS) on the T cell by the major histocompatibility complex (MHCII) peptide and co-stimulatory molecules on the antigen presenting cell (APC). Intracellular signalling through the ITAM motifs of CD3$\zeta$ result in T cell activation, cytokine secretion, and target cell killing (in the case of CD8+ T cells). Markers of T cell activation include CD69, CD71 and CD25 (also a marker for Treg cells), and HLA-DR (a marker of human T cell activation).

CARs combine components or functions of the TCR and associated molecules into one polypeptide. In some embodiments of any of the aspects, the polypeptide described herein is a first generation CAR, which comprises an extracellular binding domain, a hinge region, a transmembrane domain, and one or more intracellular signaling domains. The extracellular binding domain typically contains a single-chain variable fragment (scFv) derived from tumor antigen-reactive antibodies that usually has a high specificity to a specific tumor antigen. All CARs contain the CD3$\zeta$ chain domain as the intracellular signaling domain, which is the primary transmitter of T cell activation signals. In addition to scFvs, non-antibody-based approaches have also been used to direct CAR specificity, usually taking advantage of ligand/receptor pairs that normally bind to each other. In some embodiments of any of the aspects, the polypeptide described herein can comprise cytokines, innate immune receptors, TNF receptors, growth factors, and structural proteins, which have all been successfully used as CAR antigen recognition domains.

The hinge, also called a spacer, is a small structural domain that sits between the antigen recognition region and the cell's outer membrane. An ideal hinge enhances the flexibility of the scFv receptor head, reducing the spatial constraints between the CAR and its target antigen. This promotes antigen binding and synapse formation between the CAR-T cells and target cells. In some embodiments of any of the aspects, the hinge sequence of the polypeptide described herein comprises the membrane-proximal regions from other immune molecules including IgG, CD8, and CD28.

The transmembrane domain is a structural component, consisting of a hydrophobic alpha helix that spans the cell membrane. It anchors the CAR to the plasma membrane, bridging the extracellular hinge and antigen recognition domains with the intracellular signaling region. This domain is essential for the stability of the receptor as a whole. Generally, the transmembrane domain from the most membrane-proximal component of the endodomain is used, but different transmembrane domains result in different receptor stability. The CD28 transmembrane domain is known to result in a highly expressed, stable receptor. Accordingly, in some embodiments of any of the aspects, the polypeptide as described herein comprises the transmembrane domain of CD28. Using the CD3-zeta transmembrane domain is not recommended, as it can result in incorporation of the artificial TCR into the native TCR.

The intracellular T-cell signaling domain lies in the receptor's endodomain, inside the cell. After an antigen is bound to the external antigen recognition domain, CAR receptors cluster together and transmit an activation signal. Then the internal cytoplasmic end of the receptor perpetuates signaling inside the T cell. Normal T cell activation relies on the phosphorylation of immunoreceptor tyrosine-based activation motifs (ITAMs) present in the cytoplasmic domain of CD3-zeta. To mimic this process, CD3-zeta's cytoplasmic domain is commonly used as the main CAR endodomain component. In some embodiments of any of the aspects, any ITAM-containing domains can be used in the polypeptide as described herein.

T cells also require co-stimulatory molecules in addition to CD3 signaling in order to persist after activation. For this reason, the endodomains of CAR receptors typically also include one or more chimeric domains from co-stimulatory proteins. In some embodiments of any of the aspects, signaling domains from a wide variety of co-stimulatory molecules can be used in the polypeptide as described herein, including CD28, CD27, CD134 (OX40), and CD137 (4-1BB).

In some embodiments of any of the aspects, the polypeptide as described herein is a second generation CARs, which further comprises a co-stimulatory domain, like CD28 or 4-1BB. The involvement of these intracellular signaling domains improve T cell proliferation, cytokine secretion, resistance to apoptosis, and in vivo persistence.

In some embodiments of any of the aspects, the polypeptide as described herein is a third generation CAR, which combines multiple co-stimulatory domains, such as CD28-41BB or CD28-OX40, to augment T cell activity. Preclinical data show the third-generation CARs exhibit improved effector functions and better in vivo persistence as compared to second-generation CARs; see e.g., Hartmann et al (2017). "Clinical development of CAR T cells-challenges and opportunities in translating innovative treatment concepts". EMBO Molecular Medicine. 9 (9): 1183-1197; which is incorporated by reference herein in its entirety.

In some embodiments of any of the aspects, the polypeptide as described herein is a fourth generation CAR (also known as TRUCKs or armored CARs), which further comprises factors that enhance T cell expansion, persistence, and anti-tumoral activity. In some embodiments of any of the aspects, a CAR polypeptide as described herein is a fourth generation CAR, which comprises cytokines, such is IL-2, IL-5, IL-12 and co-stimulatory ligands; see e.g., Chmielewski M, Abken H (2015). "TRUCKs: the fourth generation of CARs". Expert Opinion on Biological Therapy. 15 (8): 1145-1154; which is incorporated by reference herein in its entirety.

CAR-T cell therapy uses T cells engineered with CARs for cancer therapy. The premise of CAR-T immunotherapy is to modify T cells to recognize cancer cells in order to more effectively target and destroy them. T cells are harvested from people, genetically altered, then the resulting CAR-T cells are infused into patients to attack their tumors. CAR-T cells can be either derived from T cells in a patient's own blood (autologous) or derived from the T cells of another healthy donor (allogeneic). Once isolated from a person, these T cells are genetically engineered to express a specific CAR, which programs them to target an antigen that is present on the surface of tumors. For safety, CAR-T cells are engineered to be specific to an antigen expressed on a tumor that is not expressed on healthy cells.

There are several challenges of current CAR T cell therapies, such as: the inability to control the rate of cytokine release and tumor lysis; the absence of an off switch that would terminate cytotoxic activity when tumor eradication is complete; auto-activation; T-cell fratricide; and a requirement to generate a different CAR T cell for each unique tumor antigen may be solved or mitigated using the adaptor approach. Cytokine release syndrome (CRS) is a major side effect associated with CAR treatments. Cytokine release syndrome is caused by a large, rapid release of cytokines (e.g., IL-6, TNFa, and IFNg) into the blood from immune cells affected by the immunotherapy. Signs and symptoms of cytokine release syndrome include fever, nausea, headache, rash, rapid heartbeat, low blood pressure, and trouble breathing. Most patients have a mild reaction, but sometimes, the reaction may be severe or life threatening. Another potentially severe side effect of CAR-T therapy is tumor lysis syndrome, which is the sudden release of cellular contents into the bloodstream following tumor cell lysis. Several strategies have been employed to allow the precise control of CAR expression or activity. These major control techniques trigger T cell death or limit T cell activation, and often regulate the T cells via a separate drug that can be introduced or withheld as needed.

A desirable method to control CAR activity is through CARs that are drug-inducible (i.e., "ON switch") or drug-repressible ("i.e., OFF switch). Administration of a drug can thus modulate CAR activity and reduce the occurrence of side effects. Current ON- or OFF-switch CARs use protein-based inducers, which are difficult to administer, or small-molecule inducers with poor pharmacokinetics. In several aspects described herein are CARs comprising a repressible protease whose activity can be modulated in the presence of a specific protease inhibitor. The repressible protease of the present disclosure is thus advantageous and clinically applicable compared to other ON-switch and OFF-switch CAR systems.

Another approach to reducing side effects of CAR therapy includes expressing the CAR domains as a system of multiple, separate polypeptides. In some embodiments of any of the aspects, the CAR domains are comprised by at least 2, at least 3, at least 4, or at least 5 separate polypeptides. In some embodiments of any of the aspects, the CAR domains are comprised by two separate polypeptides. Such an approach can also be referred to as a "bi-component CAR", "multi-component CAR", a "CAR polypeptide system" or a "CAR system" in which both (or all) polypeptides are required in order for the system to function. In some embodiments of any of the aspects, a "CAR system" refers to a CAR comprising at least two separate polypeptides, neither of which polypeptides is capable of both ligand recognition and signaling activation on its own. In several aspects described herein are systems comprising multiple CAR polypeptides.

Further discussion of CARs can be found, e.g., in Maus et al. Blood 2014 123:2624-35; Reardon et al. Neuro-Oncology 2014 16:1441-1458; Hoyos et al. Haematologica 2012 97:1622; Byrd et al. J Clin Oncol 2014 32:3039-47; Maher et al. Cancer Res 2009 69:4559-4562; and Tamada et al. Clin Cancer Res 2012 18:6436-6445; each of which is incorporated by reference herein in its entirety.

In multiple aspects described herein are CAR polypeptides or CAR polypeptide systems that comprise at least one of the following: repressible protease, extracellular binding domain, extracellular domain, transmembrane domain, intracellular signaling domain, detectable marker, degron domain, peptide domain, reader domain, and/or self-cleaving peptide, or any combination thereof. In some embodiments of any of the aspects, a CAR polypeptide or a CAR polypeptide system collectively (i.e., the first polypeptide and/or the second polypeptide) comprises at least the following: an extracellular domain, a transmembrane domain, and at least one intracellular signaling domain. Specific CARs described herein are not to be construed as limitations. Accordingly, in multiple aspects described herein are CAR polypeptides or CAR polypeptide systems that comprise an extracellular binding domain, a transmembrane domain, at least one intracellular signaling domain, and at least one of the following: repressible protease, extracellular domain, detectable marker, degron domain, peptide domain, reader domain, and/or self-cleaving peptide, or any combination thereof. For example, the following combinations are contemplated herein (see e.g., Table 21):

TABLE 21

Exemplary Combinations of Domains in a CAR Polypeptide or CAR Polypeptide System (that comprises an extracellular binding domain, a transmembrane domain, at least one intracellular signaling domain).

| RP | ED | DM | DD | PD | RD | SP |
|---|---|---|---|---|---|---|
| X | | | | | | |
| | X | | | | | |
| X | X | | | | | |
| | | X | | | | |
| X | | X | | | | |
| | X | X | | | | |
| X | X | X | | | | |
| | | | X | | | |
| X | | | X | | | |
| | X | | X | | | |
| X | X | | X | | | |
| | | X | X | | | |
| X | | X | X | | | |
| | X | X | X | | | |
| X | X | X | X | | | |
| | | | | X | | |
| X | | | | X | | |
| | X | | | X | | |
| X | X | | | X | | |
| | | X | | X | | |
| X | | X | | X | | |
| | X | X | | X | | |
| X | X | X | | X | | |
| | | | X | X | | |
| X | | | X | X | | |
| | X | | X | X | | |
| X | X | | X | X | | |
| | | X | X | X | | |
| X | | X | X | X | | |
| | X | X | X | X | | |
| X | X | X | X | X | | |
| | | | | | X | |
| X | | | | | X | |
| | X | | | | X | |
| X | X | | | | X | |
| | | X | | | X | |
| X | | X | | | X | |
| | X | X | | | X | |
| X | X | X | | | X | |
| | | | X | | X | |
| X | | | X | | X | |
| | X | | X | | X | |
| X | X | | X | | X | |
| | | X | X | | X | |
| X | | X | X | | X | |
| | X | X | X | | X | |
| X | X | X | X | | X | |
| | | | | X | X | |
| X | | | | X | X | |
| | X | | | X | X | |
| X | X | | | X | X | |
| | | X | | X | X | |
| X | | X | | X | X | |
| | X | X | | X | X | |
| X | X | X | | X | X | |
| | | | X | X | X | |
| X | | | X | X | X | |
| | X | | X | X | X | |
| X | X | | X | X | X | |
| | | X | X | X | X | |
| X | | X | X | X | X | |
| | X | X | X | X | X | |
| X | X | X | X | X | X | |
| | | | | | | X |
| X | | | | | | X |
| | X | | | | | X |
| X | X | | | | | X |
| | | X | | | | X |
| X | | X | | | | X |
| | X | X | | | | X |
| X | X | X | | | | X |
| | | | X | | | X |
| X | | | X | | | X |
| | X | | X | | | X |
| X | X | | X | | | X |
| | | X | X | | | X |
| X | | X | X | | | X |
| | X | X | X | | | X |
| X | X | X | X | | | X |
| | | | | X | | X |
| X | | | | X | | X |
| | X | | | X | | X |
| X | X | | | X | | X |
| | | X | | X | | X |
| X | | X | | X | | X |
| | X | X | | X | | X |
| X | X | X | | X | | X |
| | | | X | X | | X |
| X | | | X | X | | X |
| | X | | X | X | | X |
| X | X | | X | X | | X |
| | | X | X | X | | X |
| X | | X | X | X | | X |
| | X | X | X | X | | X |
| X | X | X | X | X | | X |
| | | | | | X | X |
| X | | | | | X | X |
| | X | | | | X | X |
| X | X | | | | X | X |
| | | X | | | X | X |
| X | | X | | | X | X |
| | X | X | | | X | X |

TABLE 21-continued

Exemplary Combinations of Domains in a CAR Polypeptide or CAR Polypeptide System (that comprises an extracellular binding domain, a transmembrane domain, at least one intracellular signaling domain).

| RP | ED | DM | DD | PD | RD | SP |
|----|----|----|----|----|----|----|
| X | X | X | X | X |   | X |
|   |   |   |   |   | X | X |
| X |   |   |   |   | X | X |
|   | X |   |   |   | X | X |
| X | X |   |   |   | X | X |
|   |   |   | X |   | X | X |
| X |   |   | X |   | X | X |
|   | X |   | X |   | X | X |
| X | X |   | X |   | X | X |
|   |   | X |   |   | X | X |
| X |   | X |   |   | X | X |
|   | X | X |   |   | X | X |
| X | X | X |   |   | X | X |
|   |   | X | X |   | X | X |
| X |   | X | X |   | X | X |
|   | X | X | X |   | X | X |
| X | X | X | X |   | X | X |
|   |   |   |   | X | X | X |
| X |   |   |   | X | X | X |
|   | X |   |   | X | X | X |
| X | X |   |   | X | X | X |
|   |   |   | X | X | X | X |
| X |   |   | X | X | X | X |
|   | X |   | X | X | X | X |
| X | X |   | X | X | X | X |
|   |   | X | X | X | X | X |
| X |   | X | X | X | X | X |
|   | X | X | X | X | X | X |
| X | X | X | X | X | X | X |

"RP" indicates repressible protease.
"ED" indicates extracellular domain.
"DM" indicates detectable marker.
"DD" indicates degron domain.
"PD" indicates peptide domain.
"RD" indicates reader domain.
"SP" indicates self-cleaving peptide.

In some embodiments of any of the aspects, a CAR system can comprise any combination of the types of CAR polypeptide and systems as described herein. Table 12 below shows non-limiting examples of such combinations. In some embodiments of any of the aspects, the examples shown in Table 12 can be in combination with a protease inhibitor, as described herein, or bound to or specifically bound to the protease inhibitor. In some embodiments of any of the aspects, the protease inhibitor can activate specific CAR polypeptides or systems (e.g., ON-switch, AND-gate, reader). In some embodiments of any of the aspects, the protease inhibitor can inactivate specific CAR polypeptides or systems (e.g., OFF-switch, reader).

TABLE 12

| CAR systems. | | | |
|---|---|---|---|
| ON | AND | OFF | Reader |
| X |   |   |   |
|   | X |   |   |
|   |   | X |   |
|   |   |   | X |
| X | X |   |   |
| X |   | X |   |
| X |   |   | X |
|   | X | X |   |
|   | X |   | X |
|   |   | X | X |
| X | X | X |   |
| X | X |   | X |
| X |   | X | X |
|   | X | X | X |
| X | X | X | X |

"ON" indicates the ON-switch (i.e., drug-inducible) CAR polypeptides as described herein.
"AND" indicates the AND-gate CAR polypeptides and systems as described herein.
"OFF" indicates the OFF-switch (i.e., drug-repressible) CAR polypeptides and systems as described herein.
"Reader" indicates the reader CAR polypeptides and systems as described herein In some embodiments of any of the aspects, a CAR polypeptide or system can comprise a repressible protease, a degron domain, a peptide domain, a reader domain, a self-cleaving peptide, an extracellular binding domain, a transmembrane domain, at least one intracellular signaling domain, and/or a detectable marker, as described further herein.

In several aspects, described herein are CAR polypeptides comprising a repressible protease. As used herein, the term "repressible protease" refers to a protease that can be inactivated by the presence or absence of a specific agent (e.g., that specifically binds to the protease). In some embodiments, a repressible protease is active (e.g., cleaves a protease cleavage site) in the absence of the specific agent and is inactive (e.g., does not cleave a protease cleavage site) in the presence of the specific agent. In some embodiments, the specific agent is a protease inhibitor. In some embodiments, the protease inhibitor specifically inhibits a given repressible protease as described herein. As a non-limiting example, an ON-switch CAR polypeptide, an AND-gate CAR polypeptide, an OFF-switch CAR polypeptide, and/or a reader CAR polypeptide can comprise a repressible protease as described herein.

In some embodiments of any of the aspects, a CAR polypeptide as described herein (or a CAR polypeptide system collectively) comprises 1, 2, 3, 4, 5, or more repressible protease(s). In some embodiments of any of the aspects, the CAR polypeptide or system comprises one repressible protease. In embodiments comprising multiple repressible proteases, the multiple repressible proteases can be different individual repressible proteases or multiple copies of the same repressible protease, or a combination of the foregoing.

Non-limiting examples of repressible proteases include hepatitis C virus proteases (e.g., NS3 and NS2-3); signal peptidase; proprotein convertases of the subtilisin/kexin family (furin, PCI, PC2, PC4, PACE4, PC5, PC); proprotein convertases cleaving at hydrophobic residues (e.g., Leu, Phe, Val, or Met); proprotein convertases cleaving at small amino acid residues such as Ala or Thr; proopiomelanocortin converting enzyme (PCE); chromaffin granule aspartic protease (CGAP); prohormone thiol protease; carboxypeptidases (e.g., carboxypeptidase E/H, carboxypeptidase D and carboxypeptidase Z); aminopeptidases (e.g., arginine aminopeptidase, lysine aminopeptidase, aminopeptidase B); prolyl endopeptidase; aminopeptidase N; insulin degrading enzyme; calpain; high molecular weight protease; and, caspases 1, 2, 3, 4, 5, 6, 7, 8, and 9. Other proteases include, but are not limited to, aminopeptidase N; puromycin sensitive aminopeptidase; angiotensin converting enzyme; pyroglutamyl peptidase II; dipeptidyl peptidase IV; N-arginine dibasic convertase; endopeptidase 24.15; endopeptidase 24.16; amyloid precursor protein secretases alpha, beta and gamma; angiotensin converting enzyme secretase; TGF alpha secretase; T F alpha secretase; FAS ligand secretase; TNF receptor-I and -II secretases; CD30 secretase; KL1 and KL2 secretases; IL6 receptor secretase; CD43, CD44 secretase; CD 16-1 and CD 16-11 secretases; L-selectin secretase; Folate receptor secretase; MMP 1, 2, 3, 7, 8, 9, 10, 11, 12, 13, 14, and 15; urokinase plasminogen activator; tissue plasminogen activator; plasmin; thrombin; BMP-1 (procollagen C-peptidase); ADAM 1, 2, 3, 4, 5, 6, 7, 8, 9, 10, and 11; and, granzymes A, B, C, D, E, F, G, and H. For a discussion of proteases, see, e.g., V. Y. H. Hook, Proteolytic and cellular mechanisms in prohormone and proprotein processing, RG Landes Company, Austin, Tex., USA (1998); N. M. Hooper et al., Biochem. J. 321: 265-279 (1997); Z. Werb, Cell 9 1: 439-442 (1997); T. G. Wolfsberg et al., J. Cell Biol. 131: 275-278 (1995); K. Murakami and J. D. Etlinger, Biochem. Biophys. Res. Comm. 146: 1249-1259 (1987); T. Berg et al., Biochem. J. 307: 313-326 (1995); M. J. Smyth and J. A. Trapani, Immunology Today 16: 202-206 (1995); R. V. Talanian et al., J. Biol. Chem. 272: 9677-9682 (1997); and N. A. Thornberry et a, J. Biol. Chem. 272: 17907-1791 1 (1997); International Patent Application WO2019118518; the contents of each of which are incorporated herein by reference in their entireties.

In some embodiments of any of the aspects, the repressible protease is hepatitis C virus (HCV) nonstructural protein 3 (NS3). NS3, also known as p-70, is a viral nonstructural protein that is a 70 kDa cleavage product of the hepatitis C virus polyprotein. The 631-residue HCV NS3 protein is a dual-function protein, containing the trypsin/chymotrypsin-like serine protease in the N-terminal region and a helicase and nucleoside triphosphatase in the C-terminal region. The minimal sequences required for a functional serine protease activity comprise the N-terminal 180 amino acids of the NS3 protein, which can also be referred to as "NS3a". Deletion of up to 14 residues from the N terminus of the NS3 protein is tolerated while maintaining the serine protease activity. Accordingly, the repressible proteases described herein comprise at the least residues 14-180 of the wildtype NS3 protein.

HCV has at least seven genotypes, labeled 1 through 7, which can also be further designated with "a" and "b" subtypes. Accordingly, the repressible protease can be an HCV genotype 1 NS3, an HCV genotype 1a NS3, an HCV genotype 1b NS3, an HCV genotype 2 NS3, an HCV genotype 2a NS3, an HCV genotype 2b NS3, an HCV genotype 3 NS3, an HCV genotype 3a NS3, an HCV genotype 3b NS3, an HCV genotype 4 NS3, an HCV genotype 4a NS3, an HCV genotype 4b NS3, an HCV genotype 5 NS3, an HCV genotype 5a NS3, an HCV genotype 5b NS3, an HCV genotype 6 NS3, an HCV genotype 6a NS3, an HCV genotype 6b NS3, an HCV genotype 7 NS3, an HCV genotype 7a NS3, or an HCV genotype 7b NS3. In some embodiments of any of the aspects, the repressible protease can be any known HCV NS3 genotype, variant, or mutant, e.g., that maintains the same function. In some embodiments of any of the aspects, the NS3 sequence comprises residues 1-180 of the NS3 protein from HCV-H, HCV-1, HCV-J1, HCV-BK, HCV-JK1, HCV-J4, HCV-J, HCV-J6, C14112, HCV-J8, D14114, HCV-Nz11, or HCV-K3a (see e.g., Chao Lin, Chapter 6: HCV NS3-4A Serine Protease, Hepatitis C Viruses: Genomes and Molecular Biology, Editor: Tan S L, Norfolk (UK): Horizon Bioscience, 2006; the content of which is incorporated herein by reference in its entirety). In some embodiments of any of the aspects, the repressible protease is a chimera of 2, 3, 4, 5, or more different NS3 genotypes, variants, or mutants as described herein, such that the protease maintains its cleavage and/or binding functions.

In some embodiments of any of the aspects, the repressible protease of a CAR polypeptide as described herein comprises SEQ ID NOs: 49, 129-136, 179-183 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 49, 129-136, or 179-183 that maintains the same functions as one of SEQ ID NOs: 49, 129-136, or 179-183. In some embodiments of any of the aspects, the repressible protease of a CAR polypeptide as described herein comprises SEQ ID NOs: 49, 129-136, 179-183 or an amino acid sequence that is at least 95% identical to the sequence of one of SEQ ID NOs: 49, 129-136, or 179-183 that maintains the same functions as one of SEQ ID NOs: 49, 129-136, or 179-183.

In some embodiments, the repressible protease of a CAR polypeptide as described herein is encoded by a nucleic acid sequence comprising SEQ ID NO: 16 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 16 that maintains the same function or a codon-optimized version of SEQ ID NO: 16. In some embodiments, the repressible protease of a CAR polypeptide as described herein is encoded by a nucleic acid sequence comprising SEQ ID NO: 16 or a sequence that is at least 95% identical to SEQ ID NO: 16 that maintains the same function.

In some embodiments of any of the aspects, the repressible protease of a CAR polypeptide as described herein does not comprise at most the first (i.e., N-terminal) residues of SEQ ID NOs: 49 or 129-136. In some embodiments of any of the aspects, the repressible protease of a CAR polypeptide as described herein comprises residues 1-180, 2-180, 3-180, 4-180, 5-180, 6-180, 7-180, 8-180, 9-180, 10-180, 11-180, 12-180, 13-180, 14-180, 15-180, 16-180, 17-180, 18-180, 19-180, 20-180, 21-180, 22-180, 23-180, 24-180, 25-180, 26-180, 27-180, 28-180, 29-180, or 30-180 of SEQ ID NOs: 49, 129-136, or 179-183.

```
SEQ ID NO: 16, NS3 (genotype 1A), 567 nt; bold dotted underlined text
(e.g., nt 169-171 of SEQ ID NO: 16) indicates His-57 of the catalytic triad;
italicized double underlined text (e.g., nt 241-243 of SEQ ID NO: 16) indicates
Asp-81 of the catalytic triad; bold italicized dotted underlined text
(e.g., nt 415-417 of SEQ ID NO: 16) indicates Ser-139 of the catalytic triad;
zig zag underlined text (e.g.,nt 502-504 of SEQ ID NO: 16) indicates Asp-168.
GCGCCCATCACGGCGTACGCCCAGCAGACGAGAGGCCTCCTAGGGTGTATAATCACCAGCC

TGACTGGCCGGGACAAAAACCAAGTGGAGGGTGAGGTCCAGATCGTGTCAACTGCTACCCA
```

```
AACCTTCCTGGCAACGTGCATCAATGGGGTATGCTGGGCAGTCTACCACGGGGCCGGAACG

AGGACCATCGCATCACCCAAGGGTCCTGTCATCCAGATGTATACCAATGTGGACCAA_GAC_CT

TGTGGGCTGGCCCGCTCCTCAAGGTTCCCGCTCATTGACACCCTGTACCTGCGGCTCCTCGGA

CCTTTACCTGGTCACGAGGCACGCCGATGTCATTCCCGTGCGCCGGCGAGGTGATAGCAGGG

GTAGCCTGCTTTCGCCCCGGCCCATTTCCTACTTGAAAGGCTCC**_TCG_**GGGGGTCCGCTGTTGT

GCCCCGCGGGACACGCCGTGGGCCTATTCAGGGCCGCGGTGTGCACCCGTGGAGTGGCTAA

AGCGGTG_GAC_TTTATCCCTGTGGAGAACCTAGAGACAACCATGAGATCCCCGGTGTTCACGG

ACAACTCCTCT

SEQ ID NO: 49, NS3 (genotype 1A), 189 aa; bold dotted underlined text
indicates His-57 of the catalytic triad; italicized double underlined text
indicates Asp-81 of the catalytic triad; bold italicized dotted underlined
text indicates Ser-139 of the catalytic triad; zig zag underlined text
indicates Asp-168.
APITAYAQQTRGLLGCIITSLTGRDKNQVEGEVQIVSTATQTFLATCINGVCWAVYHGAGTRTIA

SPKGPVIQMYTNVDQ_D_LVGWPAPQGSRSLTPCTCGSSDLYLVTRHADVIPVRRRGDSRGSLLSPR

PISYLKGS**_S_**GGPLLCPAGHAVGLFRAAVCTRGVAKAV_D_FIPVENLETTMRSPVFTDNSS

SEQ ID NO: 129, NS3 (genotype 1A), 180 aa (see e.g., residues 1027-1206 of Hepatitis C
virus genotype 1 polyprotein, NCBI Reference Sequence: NP_671491.1.
APITAYAQQTRGLLGCIITSLTGRDKNQVEGEVQIVSTATQTFLATCINGVCWTVYHGAGTRTIAS

PKGPVIQMYTNVDQDLVGWPAPQGSRSLTPCTCGSSDLYLVTRHADVIPVRRRGDSRGSLLSPRP

ISYLKGSSGGPLLCPAGHAVGLFRAAVCTRGVAKAVDFIPVENLETTMR

SEQ ID NO: 130, NS3 (genotype 1B), 180 aa (see e.g., residues 1-180 Chain A, Ns3
Protease, PDB: 4K8B_A)
APITAYSQQTRGLLGCIITSLTGRDKNQVEGEVQVVSTATQSFLATCVNGVCWTVYHGAGSKTL

AGPKGPITQMYTNVDQDLVGWQAPPGARSLTPCTCGSSDLYLVTRHADVIPVRRRGDSRGSLLS

PRPVSYLKGSSGGPLLCPSGHAVGIFRAAVCTRGVAKAVDFVPVESMETTMR

SEQ ID NO: 131, NS3 (genotype 2), 180 aa (see e.g., residues 1031-1210 of Hepatitis C
virus genotype 2 polyprotein, NCBI Reference Sequence: YP_001469630.1
APITAYAQQTRGLLGTIVVSMTGRDKTEQAGEIQVLSTVTQSFLGTSISGVLWTVYHGAGNKTLA

GSRGPVTQMYSSAEGDLVGWPSPPGTKSLEPCTCGAVDLYLVTRNADVIPARRRGDKRGALLSP

RPLSTLKGSSGGPVLCPRGHAVGVFRAAVCSRGVAKSIDFIPVETLDIVTR

SEQ ID NO: 132, NS3 (genotype 3), 180 aa (see e.g., residues 1033-1212 of Hepatitis C
virus genotype 3 polyprotein, NCBI Reference Sequence: YP_001469631.1)
APITAYAQQTRGLLGTIVTSLTGRDKNVVTGEVQVLSTATQTFLGTTVGGVIWTVYHGAGSRTL

AGAKHPALQMYTNVDQDLVGWPAPPGAKSLEPCACGSSDLYLVTRDADVIPARRRGDSTASLL

SPRPLACLKGSSGGPVMCPSGHVAGIFRAAVCTRGVAKSLQFIPVETLSTQAR

SEQ ID NO: 133, NS3 (genotype 4), 180 aa (see e.g., residues 1027-1206 of Hepatitis C
virus genotype 4 polyprotein, NCBI Reference Sequence: YP_001469632.1)
APITAYAQQTRGLFSTIVTSLTGRDTNENCGEVQVLSTATQSFLGTAVNGVMWTVYHGAGAKTI

SGPKGPVNQMYTNVDQDLVGWPAPPGVRSLAPCTCGSADLYLVTRHADVIPVRRRGDTRGALL

SPRPISILKGSSGGPLLCPMGHRAGIFRAAVCTRGVAKAVDFVPVESLETTMR

SEQ ID NO: 134, NS3 (genotype 5), 180 aa (see e.g., residues 1028-1207 of Hepatitis C
virus genotype 5 polyprotein, NCBI Reference Sequence: YP_001469633.1)
APITAYAQQTRGVLGAIVLSLTGRDKNEAEGEVQFLSTATQTFLGICINGVMWTLFHGAGSKTLA

GPKGPVVQMYTNVDKDLVGWPSPPGKGSLTRCTCGSADLYLVTRHADVIPARRRGDTRASLLS

PRPISYLKGSSGGPIMCPSGHVVGVFRAAVCTRGVAKALEFVPVENLETTMR
```

SEQ ID NO: 135, NS3 (genotype 6), 180 aa (see e.g., residues 1032-1211 of Hepatitis C
virus genotype 6 polyprotein, NCBI Reference Sequence: YP_001469634.1)
APITAYAQQTRGLVGTIVTSLTGRDKNEAEGEVQVVSTATQSFLATTINGVLWTVYHGAGSKNL

AGPKGPVCQMYTNVDQDLVGWPAPLGARSLAPCTCGSSDLYLVTRGADVIPARRRGDTRAALL

SPRPISTLKGSSGGPLMCPSGHVVGLFRAAVCTRGVAKALDFIPVENMDTTMR

SEQ ID NO: 136, NS3 (genotype 7), 180 aa (see e.g., residues 1031-1210 of Hepatitis C
virus genotype 7 polyprotein, NCBI Reference Sequence: YP_009272536.1)
APISAYAQQTRGLISTLVVSLTGRDKNETAGEVQVLSTSTQTFLGTNVGGVMWGPYHGAGTRTV

AGRGGPVLQMYTSVSDDLVGWPAPPGSKSLEPCSCGSADLYLVTRNADVLPLRRKGDGTASLLS

PRPVSSLKGSSGGPVLCPQSHCVGIFRAAVCTRGVAKAVQFVPIEKMQVAQR

SEQ ID NO: 179, NS3 genotype 1a (HCV-H), 180 aa
APITAYAQQTRGLLGCIITSLTGRDKNQVEGEVQIVSTATQTFLATCINGVCWTVYHGAGTRTIAS

PKGPVIQMYTNVDQDLVGWPAPQGSRSLTPCTCGSSDLYLVTRHADVIPVRRRGDSRGSLLSPRP

ISYLKGSSGGPLLCPAGHAVGLFRAAVCTRGVTKAVDFIPVENLETTMR

SEQ ID NO: 180, NS3 genotype 1b (HCV-BK), 180 aa
APITAYSQQTRGLLGCIITSLTGRDKNQVEGEVQVVSTATQSFLATCVNGVCWTVYHGAGSKTL

AAPKGPITQMYTNVDQDLVGWPKPPGARSLTPCTCGSSDLYLVTRHADVIPVRRRGDSRGSLLS

PRPVSYLKGSSGGPLLCPFGHAVGIFRAAVCTRGVAKAVDFVPVESMETTMR

SEQ ID NO: 181, NS3 genotype 2a (HCV-J6), 180 aa
APITAYAQQTRGLLGTIVVSMTGRDKTEQAGEIQVLSTVTQSFLGTTISGVLWTVYHGAGNKTL

AGSRGPVTQMYSSAEGDLVGWPSPPGTKSLEPCTCGAVDLYLVTRNADVIPARRRGDKRGALLS

PRPLSTLKGSSGGPVLCPRGHAVGVFRAAVCSRGVAKSIDFIPVETLDIVTR

SEQ ID NO: 182, NS3 genotype 2b (HCV-J8), 180 aa
APITAYTQQTRGLLGAIVVSLTGRDKNEQAGQVQVLSSVTQTFLGTSISGVLWTVYHGAGNKTL

AGPKGPVTQMYTSAEGDLVGWPSPPGTKSLDPCTCGAVDLYLVTRNADVIPVRRKDDRRGALL

SPRPLSTLKGSSGGPVLCSRGHAVGLFRAAVCARGVAKSIDFIPVESLDVATR

SEQ ID NO: 183, NS3 genotype 3a (HCV-Nz11), 180 aa
APITAYAQQTRGLLGTIVTSLTGRDKNVVTGEVQVLSTATQTFLGTTVGGVIWTVYHGAGSRTL

AGAKHPALQMYTNVDQDLVGWPAPPGAKSLEPCACGSSDLYLVTRDADVIPARRRGDSTASLL

SPRPLACLKGSSGGPVMCPSGHVAGIFRAAVCTRGVAKSLQFIPVETLSTQAR

In some embodiments of any of the aspects, the polypeptide further comprising a cofactor for the repressible protease. As used herein the term "cofactor for the repressible protease" refers to a molecule that increases the activity of the repressible protease. In some embodiments of any of the aspects, a CAR polypeptide as described herein comprises 1, 2, 3, 4, 5, or more cofactors for the repressible protease. In some embodiments of any of the aspects, the CAR polypeptide comprises one cofactor for each repressible protease. In embodiments comprising multiple cofactors for the repressible protease, the multiple cofactors for the repressible protease can be different individual cofactors or multiple copies of the same cofactor, or a combination of the foregoing.

In some embodiments of any of the aspects, the cofactor is an HSV NS4A domain, and the repressible protease is HSV NS3. The nonstructural protein 4a (NS4A) is the smallest of the nonstructural HCV proteins. The NS4A protein has multiple functions in the HCV life cycle, including (1) anchoring the NS3-4A complex to the outer leaflet of the endoplasmic reticulum and mitochondrial outer membrane, (2) serving as a cofactor for the NS3A serine protease, (3) augmenting NS3A helicase activity, and (4) regulating NS5A hyperphosphorylation and viral replication. The interactions between NS4A and NS4B control genome replication and between NS3 and NS4A play a role in virus assembly.

In some embodiments of any of the aspects, a CAR polypeptide as described herein comprises the portion of the NS4a polypeptide that serves as a cofactor for NS3. Deletion analysis has shown that the central region (approximately residues 21 to 34) of the 54-residue NS4A protein is essential and sufficient for the cofactor function of the NS3 serine protease. Accordingly, in some embodiments of any of the aspects, the repressible protease cofactor comprises a 14-residue region of the wildtype NS4A protein.

In some embodiments of any of the aspects, the cofactor for the repressible protease can be an HCV genotype 1 NS4A, an HCV genotype 1a NS4A, an HCV genotype 1b NS4A, an HCV genotype 2 NS4A, an HCV genotype 2a NS4A, an HCV genotype 2b NS4A, an HCV genotype 3 NS4A, an HCV genotype 3a NS4A, an HCV genotype 3b NS4A, an HCV genotype 4 NS4A, an HCV genotype 4a NS4A, an HCV genotype 4b NS4A, an HCV genotype 5 NS4A, an HCV genotype 5a NS4A, an HCV genotype 5b NS4A, an HCV genotype 6 NS4A, an HCV genotype 6a NS4A, an HCV genotype 6b NS4A, an HCV genotype 7 NS4A, an HCV genotype 7a NS4A, or an HCV genotype 7b NS4A. In some embodiments of any of the aspects, the cofactor for the repressible protease can be any known NS4A genotype, variant, or mutant, e.g., that maintains the same function. In some embodiments of any of the aspects, the NS4A sequence comprises residues 21-31 of the NS4A protein from HCV-H, HCV-1, HCV-J1, HCV-BK, HCV-JK1, HCV-J4, HCV-J, HCV-J6, C14112, HCV-J8, D14114, HCV-Nz11, or HCV-K3a (see e.g., Chao Lin 2006 supra; see e.g., Table 13).

In some embodiments of any of the aspects, the cofactor for a repressible protease of a CAR polypeptide as described herein comprises SEQ ID NOs: 48, 98, 137-156, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 48, 98, 137-156 that maintains the same functions as one of SEQ ID NOs: 48, 98, 137-156. In some embodiments of any of the aspects, the cofactor for a repressible protease of a CAR polypeptide as described herein comprises SEQ ID NOs: 48, 98, 137-156, or an amino acid sequence that is at least 95% identical to the sequence of one of SEQ ID NOs: 48, 98, 137-156 that maintains the same functions as one of SEQ ID NOs: 48, 98, 137-156.

In some embodiments of any of the aspects, the cofactor for a repressible protease of a CAR polypeptide as described herein is encoded by a nucleic acid sequence comprising SEQ ID NOs: 15, 74 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NOs: 15 or 74 that maintains the same function, or a codon-optimized version thereof. In some embodiments of any of the aspects, the cofactor for a repressible protease of a CAR polypeptide as described herein is encoded by a nucleic acid sequence comprising SEQ ID NOs: 15, 74 or a sequence that is at least 95% identical to SEQ ID NOs: 15 or 74 that maintains the same function.

In some embodiments of any of the aspects, the cofactor for the repressible protease of a CAR polypeptide as described herein comprises residues 1-14, 1-13, 1-12, 1-11, 1-10, 2-14, 2-13, 2-12, 2-11, 2-10, 3-14, 3-13, 3-12, 3-11, 3-10, 4-14, 4-13, 4-12, 4-11, or 4-10 of any of SEQ ID NOs: 48, 98, 137-143.

```
NS4A (genotype 1A), 39 nt
                                                        SEQ ID NO: 15
GGCTGCGTGGTCATAGTGGGCAGGATCGTCTTGTCCGGA NS4A (genotype 1B), 36 nt
                                                        SEQ ID NO: 74
GGTTCTGTTGTTATTGTTGGTAGAATTATTTTATCT NS4A (genotype 1A), 13 aa,
                                                        SEQ ID NO: 48
GCVVIVGRIVLSG NS4A (genotype 1B), 12 aa,
                                                        SEQ ID NO: 98
GSVVIVGRIILS;
see e.g., Chain C, Nonstructural Protein, PDB: 4K8B_C.

NS4A (genotype 1), 14 aa (see e.g., residues 1678-1691 of Hepatitis C
virus genotype 1 polyprotein, NCBI Reference Sequence: NP_671491.1):
                                                        SEQ ID NO: 137
GCVVIVGRIVLSGK NS4A (genotype 2), 14 aa (see e.g., residues 1682-1695 of Hepatitis C
virus genotype 2 polyprotein, NCBI Reference Sequence: YP_001469630.1:
                                                        SEQ ID NO: 138
GCVCIIGRLHINQR NS4A (genotype 3), 14 aa (see e.g., residues 1684-1697 of Hepatitis C
virus genotype 3 polyprotein, NCBI Reference Sequence: YP_001469631.1):
                                                        SEQ ID NO: 139
GCVVIVGHIELEGK NS4A (genotype 4), 14 aa (see e.g., residues 1678-1691 of Hepatitis C
virus genotype 4 polyprotein, NCBI Refer-
ence Sequence: YP_001469632.1):
                                                        SEQ ID NO: 140
GSVVIVGRVVLSGQ NS4A (genotype 5), 14 aa (see e.g., residues 1679-1692 of Hepatitis C
virus genotype 5 polyprotein, NCBI Reference Sequence: YP_001469633.1):
                                                        SEQ ID NO: 141
GSVAIVGRIILSGR NS4A (genotype 6), 14 aa (see e.g., residues 1683-1696 of Hepatitis C
virus genotype 6 polyprotein, NCBI Reference Sequence: YP_001469634.1):
                                                        SEQ ID NO: 142
GCVVICGRIVTSGK
```

-continued

NS4A (genotype 7), 14 aa (see e.g., residues 1682-1695 of Hepatitis C
virus genotype 7 polyprotein, NCBI Reference Sequence: YP_009272536.1):
SEQ ID NO: 143
GSVVVVGRVVLGSN In some embodiments of any of the aspects, the NS4A sequence is selected from Table 13. In one embodiment, the NS4A comprises residues 21-31 of SEQ ID NO: 144-156 or a sequence that is at least 70% identical.

TABLE 13

Exemplary NS4A sequences (see e.g., Chao Lin 2006 supra).
Residues 21-31 are bolded.

| SEQ ID NO | Genotype (strain) | Sequence |
|---|---|---|
| 144 | 1a (HCV-H) | STWVL VGGVL AALAA YCLST GCVVI VGRIV LSGKP AIIPD REVLY QEFDE MEEC |
| 145 | 1a (HCV-1) | STWVL VGGVL AALAA YCLST GCVVI VGRVV LSGKP AIIPD REVLY REFDE MEEC |
| 146 | 1a (HCV-J1) | STWVL VGGVL AALAA YCLST GCVVI VGRIV LSGRP AIIPD REVLY REFDE MEEC |
| 147 | 1b (HCV-BK) | STWVL VGGVL AALAA YCLTT GSVVI VGRII LSGRP AIVPD RELLY QEFDE MEEC |
| 148 | 1b (HCV-JK1) | STWVL VGGVL AALAA YCLTT GSVVI VGRII LSGRP AIIPD RELLY QEFDE MEEC |
| 149 | 1b (HCV-J4) | STWVL VGGVL AALAA YCLTT GSVVI VGRII LSGKP AVVPD RELLY QEFDE MEEC |
| 150 | 1b (HCV-J) | STWVL VGGVL AALAA YCLTT GSVVI VGRII LSGRP AVIPD RELLY REFDE MEEC |
| 151 | 2a (HCV-J6) | STWVL AGGVL AAVAA YCLAT GCVCI IGRLH VNQRA VVAPD KEVLY EAFDE MEEC |
| 152 | 2a (D14112) | STWVL AGGVL AAVAA YCLAT GCVSI IGRLH INGRA VVAPD KEVLY EAFDE MEEC |
| 153 | 2b (HCV-J8) | SSWVL AGGVL AAVAA YCLAT GCISI IGRLH LNDRV VVAPD KEILY EAFDE MEEC |
| 154 | 2b (D14114) | STWVL AGGVL AAVAA YCLAT GCVSI IGRLH LNDQV VVTPD KEILY EAFDE MEEC |
| 155 | 3a (HCV-Nz11) | STWVL LGGVL AALAA YCLSV GCVVI VGHIE LEGKP ALVPD KEVLY QQYDE MEEC |
| 156 | 3a (HCV-K3a) | STWVL LGGVL AAVAA YCLSV GCVVI VGHIE LGGKP ALVPD KEVLY QQYDE MEEC |

In some embodiments of any of the aspects, a CAR polypeptide as described herein can comprise any combination of NS3 and NS4A genotypes, variants, or mutants as described herein. In one embodiment, the NS3 and NS4A are selected from selected from the same genotype as each other. In some embodiments of any of the aspects, the NS3 is genotype 1a and the NS4A is genotype 1b. In some embodiments of any of the aspects, the NS3 is genotype 1b and the NS4A is genotype 1a.

In some embodiments of any of the aspects, a CAR polypeptide as described herein comprises an HSV NS4A domain adjacent to the NS3 repressible protease. In some embodiments of any of the aspects, the NS4A domain is N-terminal of the NS3 repressible protease. In some embodiments of any of the aspects, the NS4A domain is C-terminal of the NS3 repressible protease. In some embodiments of any of the aspects, the CAR polypeptide comprises a linker between the NS4A domain and the NS3 repressible protease. Non-limiting examples of linker (e.g., between the NS4A domain and the NS3 repressible protease) include: SGTS (SEQ ID NO: 157) and GSGS (SEQ ID NO: 158).

In some embodiments of any of the aspects, any two domains as described herein in a CAR polypeptide can be joined into a single polypeptide by positioning a peptide linker, e.g., a flexible linker between them. As used herein "peptide linker" refers to an oligo- or polypeptide region from about 2 to 100 amino acids in length, which links together any of the sequences of the polypeptides as described herein. In some embodiment, linkers can include or be composed of flexible residues such as glycine and serine so that the adjacent protein domains are free to move relative to one another. Longer linkers may be used when it is desirable to ensure that two adjacent domains do not sterically interfere with one another. Linkers may be cleavable or non-cleavable.

Described herein are CAR polypeptides comprising protease cleavage sites (e.g., ON-switch CAR polypeptides and the first AND-gate CAR polypeptide). As used herein, the term "protease cleavage site" refers to a specific sequence or sequence motif recognized by and cleaved by the repressible protease. A cleavage site for a protease includes the specific amino acid sequence or motif recognized by the protease during proteolytic cleavage and typically includes the surrounding one to six amino acids on either side of the scissile bond, which bind to the active site of the protease and are used for recognition as a substrate. In some embodiments of any of the aspects, the protease cleavage site can be any site specifically bound by and cleaved by the repressible protease. In some embodiments of any of the aspects, a CAR polypeptide as described herein (or the CAR polypeptide system collectively) comprises 1, 2, 3, 4, 5, or more protease cleavage sites. In some embodiments of any of the aspects, the CAR polypeptide comprises two protease cleavage sites. In embodiments comprising multiple protease cleavage sites, the multiple protease cleavage sites can be different individual protease cleavage sites or multiple copies of the same protease cleavage sites, or a combination of the foregoing.

As a non-limiting example, during HCV replication, the NS3-4A serine protease is responsible for the proteolytic cleavage at four junctions of the HCV polyprotein precursor: NS3/NS4A (self-cleavage), NS4A/NS4B, NS4B/NS5A, and NS5A/NS5B. Accordingly, the protease cleavage site of a CAR polypeptide as described herein can be a NS3/NS4A cleavage site, a NS4A/NS4B cleavage site, a NS4B/NS5A cleavage site, or a NS5A/NS5B cleavage site. The protease cleavage site can be a protease cleavage sites from HCV genotype 1, genotype 1a, genotype 1b, genotype 2, genotype 2a, genotype 2b, genotype 3, genotype 3a, genotype 3b, genotype 4, genotype 4a, genotype 4b, genotype 5, genotype 5a, genotype 5b, genotype 6, genotype 6a, genotype 6b, genotype 7, genotype 7a NS4A, or genotype 7b. In some embodiments of any of the aspects, the protease cleavage site can be any known NS3/NS4A protease cleavage site or variant or mutant thereof, e.g., that maintains the same function. In some embodiments of any of the aspects, the NS4A sequence comprises residues 21-31 of the NS4A protein from HCV-H, HCV-1, HCV-J1, HCV-BK, HCV-JK1, HCV-J4, HCV-J, HCV-J6, C14112, HCV-J8, D14114, HCV-Nz11, or HCV-K3a (see e.g., Chao Lin 2006 supra).

In some embodiments of any of the aspects, the protease cleavage site of a CAR polypeptide as described herein comprises SEQ ID NOs: 45, 50, 159-178, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 45, 50, 159-178 that maintains the same functions as one of SEQ ID NOs: 45, 50, 159-178. In some embodiments of any of the aspects, the protease cleavage site of a CAR polypeptide as described herein comprises SEQ ID NOs: 45, 50, 159-178, or an amino acid sequence that is at least 95% identical to the sequence of one of SEQ ID NOs: 45, 50, 159-178 that maintains the same functions as one of SEQ ID NOs: 45, 50, 159-178.

In some embodiments of any of the aspects, the repressible protease of a CAR polypeptide as described herein is encoded by a nucleic acid sequence comprising SEQ ID NOs: 12, 17 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to one of SEQ ID NOs: 12 or 17 that maintains the same function, or a codon-optimized version thereof. In some embodiments of any of the aspects, the repressible protease of a CAR polypeptide as described herein is encoded by a nucleic acid sequence comprising SEQ ID NOs: 12, 17 or a sequence that is at least 95% identical to one of SEQ ID NOs: 12 or 17 that maintains the same function.

In some embodiments of any of the aspects, the protease cleavage site of a CAR polypeptide as described herein comprises residues 1-20, 1-19, 1-18, 1-17, 1-16, 1-15, 2-20, 2-19, 2-18, 2-17, 2-16, 2-15, 3-20, 3-19, 3-18, 3-17, 3-16, 3-15, 4-20, 4-19, 4-18, 4-17, 4-16, 4-15, 5-20, 5-19, 5-18, 5-17, 5-16, or 5-15, of any of SEQ ID NOs: 45, 50, 159-178.

NS5A/5B cut site (CC), 30 nt
SEQ ID NO: 12
GAGGACGTGGTGTGCTGCCACTCAATCTAC

NS4A/4B cut site (CS), 42 nt
SEQ ID NO: 17
CTCTACCAGGAGTTCGATGAGATGGAAGAGTGCTCTCAGCAC NS5A/5B cut site (CC), 10 aa,
SEQ ID NO: 45
EDVVCCHSIY NS4A/4B cut site (CS), 14 aa,
SEQ ID NO: 50
LYQEFDEMEECSQH

TABLE 14

Exemplary NS3/NS4A protease cleavage sites (see e.g., Chao Lin 2006 supra).

| Cleavage Site Type | SEQ ID NO | Genotype (Strain) | Sequence (cleavage site shown with space) |
|---|---|---|---|
| NS3/NS4A | 159 | 1a (HCV-H) | CMSADLEVVT STWVLVGGVL |
|  | 160 | 1b (HCV-BK) | CMSADLEVVT STWVLVGGVL |
|  | 161 | 2a (HCV-J6) | CMQADLEVMT STWVLAGGVL |
|  | 162 | 2b (HCV-J8) | CMQADLEIMT SSWVLAGGVL |
|  | 163 | 3a (HCV-Nz11) | CMSADLEVTT STWVLLGGVL |
| NS4A/NS4B | 164 | 1a (HCV-H) | YQEFDEMEEC SQHLPYIEQG |
|  | 165 | 1b (HCV-BK) | YQEFDEMEEC ASHLPYIEQG |
|  | 166 | 2a (HCV-J6) | YEAFDEMEEC ASRAALIEEG |
|  | 167 | 2b (HCV-J8) | YEAFDEMEEC ASKAALIEEG |
|  | 168 | 3a (HCV-Nz11) | YQQYDEMEEC SQAAPYIEQA |
| NS4B/NS5A | 169 | 1a (HCV-H) | WISSECTTPC SGSWLRDVWD |
|  | 170 | 1b (HCV-BK) | WINEDCSTPC SGSWLRDVWD |
|  | 171 | 2a (HCV-J6) | WITEDCPIPC SGSWLRDVWD |
|  | 172 | 2b (HCV-J8) | WITEDCPVPC SGSWLQDIWD |
|  | 173 | 3a (HCV-Nz11) | WINEDYPSPC SDDWLRTIWD |
| NS5A/NS5B | 174 | 1a (HCV-H) | GADTEDVVCC SMSYSWTGAL |
|  | 175 | 1b (HCV-BK) | EEASEDVVCC SMSYTWTGAL |
|  | 176 | 2a (HCV-J6) | SEEDDSVVCC SMSYSWTGAL |
|  | 177 | 2b (HCV-J8) | SDQEDSVICC SMSYSWTGAL |
|  | 178 | 3a (HCV-Nz11) | DSEEQSVVCC SMSYSWTGAL |

In some embodiments of any of the aspects, a CAR polypeptide as described herein comprises two protease cleavage sites, with one N-terminal of the NS3-NS4A complex, and the other C-terminal of the NS3-NS4A complex (see e.g., Table 15). In some embodiments of any of the aspects, the two protease cleavage sites can be the same cleavage sites or different cleavage sites.

TABLE 15

Exemplary Protease Cleavage Site Combinations.

| N | | | 3/4A | | | | | 4A/4B | |
|---|---|---|---|---|---|---|---|---|---|
| C | 3/4A | 4A/4B | 4B/5A | 5A/5B | | 3/4A | 4A/4B | 4B/5A | 5A/5B |
| N | | | 4B/5A | | | | | 5A/5B | |
| C | 3/4A | 4A/4B | 4B/5A | 5A/5B | | 3/4A | 4A/4B | 4B/5A | 5A/5B |

"N" indicates N-terminal of the NS3-NS4A complex.
"C" indicates C-terminal of the NS3-NS4A complex.
"3/4A" indicates the NS3/NS4A cleavage site.
"4A/4B" indicates the NS4A/NS4B cleavage site.
"4B/5A" indicates the NS4B/NS5A cleavage site.
"5A/5B" indicates the NS5A/NS5B cleavage site.

In some embodiments of any of the aspects, a CAR polypeptide as described herein comprise any known genotypes, variants, or mutants of NS3/NS4A, NS4A/NS4B, NS4B/NS5A, and NS5A/NS5B cleavage sites. In one embodiment, the two protease cleavage sites are selected from selected from the same genotype as each other.

In some embodiments of any of the aspects, the protease cleavage site is located or engineered such that, when the CAR (e.g., drug-inducible CAR polypeptide, first AND-gate CAR polypeptide) cleaves itself using the repressible protease in the absence of a protease inhibitor, the resulting amino acid at the N-terminus of the newly cleaved polypeptide(s) causes the polypeptide(s) to degrade at a faster rate and have a shorter half-life compared to other cleaved polypeptides. According to the N-end rule, newly cleaved polypeptides comprising the amino acid His, Tyr, Gln, Asp, Asn, Phe, Leu, Trp, Lys, or Arg at the N-terminus exhibit a high degradation rate and a short half-life (e.g., 10 minutes or less in yeast; 1-5.5 hours in mammalian reticulocytes). Comparatively, newly cleaved polypeptides comprising the amino acid Val, Met, Gly, Pro, Ala, Ser, Thr, Cys, Ile, or Glu at the N-terminus exhibit a lower degradation rate and a longer half-life (e.g., 30 minutes or more in yeast; 1-100 hours in mammalian reticulocytes). See e.g., Gonda et al., Universality and Structure of the N-end Rule, The Journal of Biological Chemistry, Vol. 264 (28), pp. 16700-16712, 1989, the content of which is incorporated herein by reference in its entirety. Accordingly, in some embodiments of any of the aspects, the resulting amino acid at the N-terminus of a newly cleaved CAR polypeptide as described herein is His, Tyr, Gln, Asp, Asn, Phe, Leu, Trp, Lys, or Arg. In some embodiments of any of the aspects, the resulting amino acid at the N-terminus of the newly cleaved CAR polypeptide as described herein is not Val, Met, Gly, Pro, Ala, Ser, Thr, Cys, Ile, or Glu.

In some embodiments of any of the aspects, the N-terminus of a newly cleaved CAR polypeptide as described herein comprises SEQ ID NO: 46 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 46 that maintains a His or another highly degraded amino acid at the N-terminus. In some embodiments of any of the aspects, the N-terminus of a newly cleaved CAR polypeptide as described herein comprises SEQ ID NO: 46 or an amino acid sequence that is at least 95% identical to the sequence of SEQ ID NO: 46 that maintains the same function.

In some embodiments of any of the aspects, the N-terminus of a newly cleaved CAR polypeptide as described herein is encoded by a nucleic acid sequence comprising SEQ ID NO: 13, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 13 that maintains a His or another highly degraded amino acid at the N-terminus or a codon-optimized version of SEQ ID NO: 13. In some embodiments of any of the aspects, the N-terminus of a newly cleaved CAR polypeptide as described herein is encoded by a nucleic acid sequence comprising SEQ ID NO: 13, or a sequence that is at least 95% identical to SEQ ID NO: 13 that maintains the same function.

SEQ ID NO: 13, N-end rule, 24 nt,
CACTCAATCTACGGCAAGAAGAAG

SEQ ID NO: 46, N-end rule, 8 aa, HSIYGKKK

In some embodiments of any of the aspects, a CAR polypeptide as described herein (e.g., ON-switch CAR polypeptide or first polypeptide of the AND-gate CAR system) comprises a repressible protease that is catalytically active. For HCV NS3, the catalytic triad comprises His-57, Asp-81, and Ser-139. In regard to a repressible protease, "catalytically active" refers to the ability to cleave at a protease cleavage site. In some embodiments of any of the aspects, the catalytically active repressible protease can be any repressible protease as described further herein that maintains the catalytic triad, i.e., comprises no non-synonymous substitutions at His-57, Asp-81, and/or Ser-139.

In some embodiments of any of the aspects, a CAR polypeptide as described herein (e.g., second polypeptide of the OFF-switch CAR system or second polypeptide of the reader CAR system) comprises a repressible protease that is catalytically inactive, i.e., dead. In regard to a repressible protease, "catalytically inactive" refers to the inability to cleave at a protease cleavage site. Accordingly, a catalytically inactive NS3 protease can comprise a nonsynonymous mutation at any one of His-57, Asp-81, and Ser-139. Non-limiting examples of NS3 inactivating mutations include H57A, D81A, S139A, or any combination thereof. As such, any one of SEQ ID NOs: 49 or 129-136 can comprise a H57A mutation; a D81A mutation; a S139A mutation; any nonsynonymous mutation to His-57, Asp-81, and Ser-139; or any combination thereof. In some embodiments of any of the aspects, any one of SEQ ID NOs: 49 or 129-136 can comprise a S139A mutation. In some embodiments of any of the aspects, a mutation to the catalytic triad does not disrupt other functions of the repressible protease, e.g., binding to a protease inhibitor, binding to a peptide domain, or binding to a reader domain.

In some embodiments of any of the aspects, a catalytically-inactive repressible protease of a CAR polypeptide as described herein comprises SEQ ID NOs: 99 or 103, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NOs: 99 or 103 that maintains the same functions as SEQ ID NOs: 99 or 103 (e.g., catalytically inactive). In some embodiments of any of the aspects, a catalytically-inactive repressible protease of a CAR polypeptide as described herein comprises SEQ ID NOs: 99 or 103, or an amino acid sequence that is at least 95% identical to the sequence of SEQ ID NOs: 99 or 103 that maintains the same functions as SEQ ID NOs: 99 or 103 (e.g., catalytically inactive).

In some embodiments of any of the aspects, a catalytically-inactive repressible protease is encoded by a nucleic acid sequence comprising SEQ ID NOs: 75, 79 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NOs: 75 or 79 that maintains the same function, or a codon-optimized version thereof. In some embodiments of any of the aspects, a catalytically-inactive repressible protease is encoded by a nucleic acid sequence comprising SEQ ID NOs: 75, 79 or a sequence that is at least 95% identical to SEQ ID NOs: 75 or 79 that maintains the same function.

```
SEQ ID NO: 75, NS3 (genotype 1B; S139A), 537 nt; bold text (e.g., nt 409-411 of SEQ ID
NO: 75) indicates the conserved S139 residue mutated to alanine, i.e., S139A.
ATCACGGCCTACTCCCAACAGACGCGGGGCCTACTTGGTTGCATCATCACTAGCCTCACAGG

CCGGGACAAGAACCAGGTCGAAGGGGAGGTTCAAGTGGTTTCTACCGCAACACAATCTTTC

CTGGCGACCTGCGTCAACGGCGTGTGCTGGACTGTCTACCATGGCGCTGGCTCGAAGACCCT

AGCCGGTCCAAAAGGTCCAATCACCCAAATGTACACCAATGTAGACCAGGACCTCGTCGGC

TGGCAGGCGCCTCCAGGGGCGCGCTCCTTGACACCATGCACCTGTGGCAGCTCGGACCTTTA

CTTGGTCACGAGACATGCTGATGTCATTCCGGTGCGCCGGCGAGGCGACAGCAGGGGAAGT

CTACTCTCCCCCAGGCCCGTCTCCTACCTGAAAGGCTCCGCAGGTGGTCCATTGCTTTGCCCT

TCGGGGCACGCTGTGGGCATCTTCCGGGCTGCTGTGTGCACCCGGGGGGTCGCGAAGGCGGT

GGACTTCGTGCCCGTTGAGTCTATGGAAACTACCATGCGGTCT

SEQ ID NO: 79, NS3 (genotype 1A; S139A), 567 nt; bold dotted underlined text
(e.g., nt 169-171 of SEQ ID NO: 16) indicates His-57 of the catalytic triad;
italicized double underlined text (e.g., nt 241-243 of SEQ ID NO: 16) indicates
Asp-81 of the catalytic triad; bold italicized dotted underlined text (e.g.,
nt 415-417 of SEQ ID NO: 16) indicates Ser-139 of the catalytic triad
mutated to alanine(S139A); zig zag underlined text
(e.g., nt 502-504 of SEQ ID NO: 16) indicates Asp-168.
GCGCCCATCACGGCGTACGCCCAGCAGACGAGAGGCCTCCTAGGGTGTATAATCACCAGCC

TGACTGGCCGGGACAAAAACCAAGTGGAGGGTGAGGTCCAGATCGTGTCAACTGCTACCCA

AACCTTCCTGGCAACGTGCATCAATGGGGTATGCTGGGCAGTCTACCACGGGGCCGGAACG

AGGACCATCGCATCACCCAAGGGTCCTGTCATCCAGATGTATACCAATGTGGACCAAGACCT

TGTGGGCTGGCCCGCTCCTCAAGGTTCCCGCTCATTGACACCCTGTACCTGCGGCTCCTCGGA

CCTTTACCTGGTCACGAGGCACGCCGATGTCATTCCCGTGCGCCGGCGAGGTGATAGCAGGG

GTAGCCTGCTTTCGCCCCGGCCCATTTCCTACTTGAAAGGCTCCGCGGGGGGTCCGCTGTTGT

GCCCCGCGGGACACGCCGTGGGCCTATTCAGGGCCGCGGTGTGCACCCGTGGAGTGGCTAA

AGCGGTGGACTTTATCCCTGTGGAGAACCTAGAGACAACCATGAGATCCCCGGTGTTCACGG

ACAACTCCTCT

SEQ ID NO: 99, NS3 (genotype 1B; S139A), 179 aa; bold text (e.g.,
aa 409-411 of SEQ ID NO: 75) indicates S139A.
ITAYSQQTRGLLGCIITSLTGRDKNQVEGEVQVVSTATQSFLATCVNGVCWTVYHGAGSKTLAG

PKGPITQMYTNVDQDLVGWQAPPGARSLTPCTCGSSDLYLVTRHADVIPVRRRGDSRGSLLSPRP

VSYLKGSAGGPLLCPSGHAVGIFRAAVCTRGVAKAVDFVPVESMETTMRS
```

SEQ ID NO: 103, NS3 (genotype 1A; S139A), 189 aa; bold dotted underlined
text (e.g., aa 169-171 of SEQ ID NO: 16) indicates His-57 of the catalytic
triad; italicized double underlined text (e.g., aa 241-243 of SEQ ID NO: 16)
indicates Asp-81 of the catalytic triad; bold italicized dotted underlined
text (e.g., aa 415-417 of SEQ ID NO: 16) indicates Ser-139
of the catalytic triad mutated to alanine (S139A); zig zag underlined
text (e.g., aa 502-504 of SEQ ID NO: 16) indicates Asp-168.
APITAYAQQTRGLLGCIITSLTGRDKNQVEGEVQIVSTATQTFLATCINGVCWAVYHGAGTRTIA

SPKGPVIQMYTNVDQDLVGWPAPQGSRSLTPCTCGSSDLYLVTRHADVIPVRRRGDSRGSLLSPR

PISYLKGSAGGPLLCPAGHAVGLFRAAVCTRGVAKAVDFIPVENLETTMRSPVFTDNSS

In some embodiments of any of the aspects, a CAR polypeptide as described herein is in combination with a protease inhibitor. As used herein, "in combination with" refers to two or more substances being present in the same formulation in any molecular or physical arrangement, e.g., in an admixture, in a solution, in a mixture, in a suspension, in a colloid, in an emulsion. The formulation can be a homogeneous or heterogeneous mixture. In some embodiments of any of the aspects, the active compound(s) can be comprised by a superstructure, e.g., nanoparticles, liposomes, vectors, cells, scaffolds, or the like, said superstructure is which in solution, mixture, admixture, suspension, etc., with the CAR polypeptide or CAR polypeptide system. In some embodiments of any of the aspects, the CAR polypeptide is bound to a protease inhibitor bound to the repressible protease. In some embodiments of any of the aspects, the CAR polypeptide is bound specifically to a protease inhibitor bound to the repressible protease.

In some embodiments of any of the aspects, the CAR polypeptide is in combination with 1, 2, 3, 4, 5, or more protease inhibitors. In some embodiments of any of the aspects, the CAR polypeptide is in combination with one protease inhibitor. In embodiments comprising multiple protease inhibitors, the multiple protease inhibitors can be different individual protease inhibitors or multiple copies of the same protease inhibitor, or a combination of the foregoing.

In some embodiments of any of the aspects, the protease inhibitor is grazoprevir (abbreviated as GZV or GZP; see e.g., PubChem CID: 44603531). In some embodiments of any of the aspects, the protease inhibitor is danoprevir (DNV; see e.g., PubChem CID: 11285588). In some embodiments of any of the aspects, the protease inhibitor is an approved NS3 protease inhibitor, such as but not limited to grazoprevir, danoprevir, simeprevir, asunaprevir, ciluprevir, boceprevir, sovaprevir, paritaprevir, ombitasvir, paritaprevir, ritonavir, dasabuvir, and telaprevir. Additional non-limiting examples of NS3 protease inhibitors are listed in Table 16 (see e.g., McCauley and Rudd, Hepatitis C virus NS3/4a protease inhibitors, Current Opinion in Pharmacology 2016, 30:84-92; the content of which is incorporated herein by reference in its entirety).

TABLE 16

Exemplary NS3/NS4A protease inhibitors

| Description or Name(s) | Structure |
|---|---|
| The N-terminal hexapeptide product of substrate cleavage (e.g., DDIVPC-OH) | 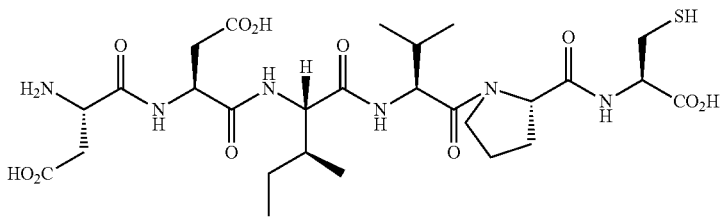 <br> 1 |
| One of the products of cleavage of the NS4a-NS4b peptide (e.g., Ac-DEMEEC-OH) | 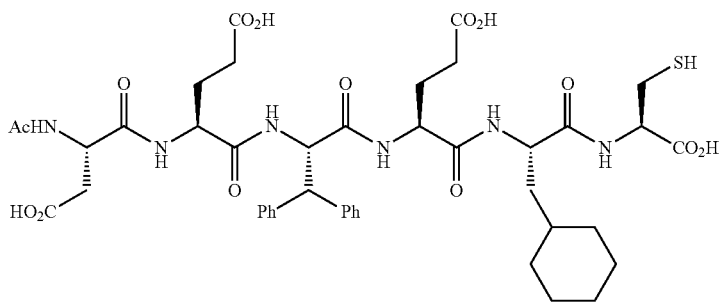 <br> 2 |

TABLE 16-continued

Exemplary NS3/NS4A protease inhibitors

| Description or Name(s) | Structure |
|---|---|
| VICTRELIS™ boceprevir SCH503034 | 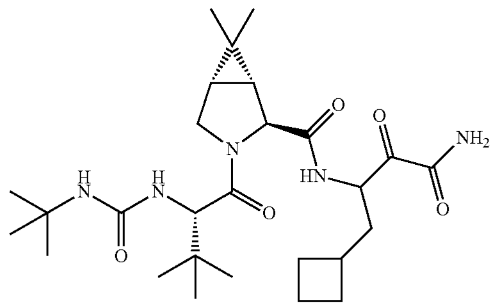 [SMILES: CC(C)(C)NC(=O)N[C@H](C(=O)N1C[C@H]2[C@@H]([C@H]1C(=O)NC(CC1CCC1)C(=O)C(N)=O)C2(C)C)C(C)(C)C] |
| INCIVEK™, INCIVIO™, telaprevir, VX-950 | 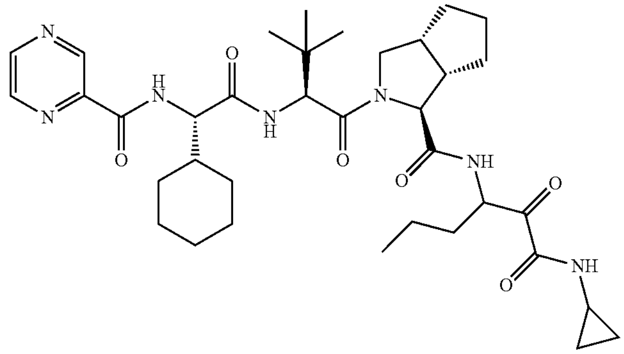 [SMILES: CCCC(NC(=O)[C@@H]1[C@H]2CCC[C@H]2CN1C(=O)[C@@H](NC(=O)[C@@H](NC(=O)c1cnccn1)C1CCCCC1)C(C)(C)C)C(=O)C(=O)NC1CC1] |
| Ciluprevir; BILN-2061 | 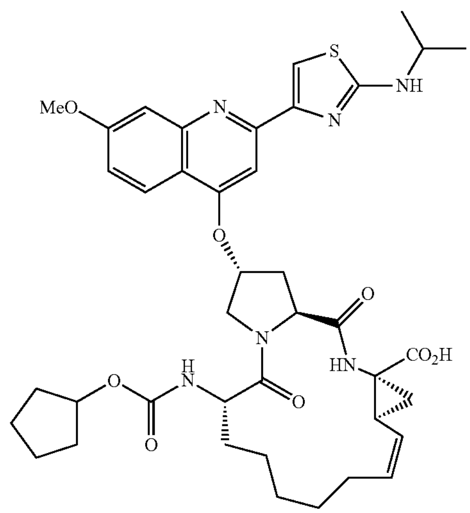 [SMILES: COc1ccc2c(O[C@@H]3C[C@H]4C(=O)N[C@]5(C(=O)O)C[C@H]5/C=C\CCCCC[C@H](NC(=O)OC5CCCC5)C(=O)N4C3)cc(-c3csc(NC(C)C)n3)nc2c1] |
| BMS-605339 | 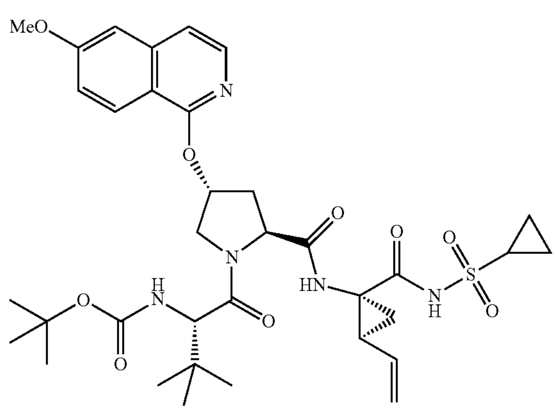 [SMILES: C=C[C@@H]1C[C@]1(NC(=O)[C@@H]1C[C@@H](Oc2nccc3cc(OC)ccc23)CN1C(=O)[C@@H](NC(=O)OC(C)(C)C)C(C)(C)C)C(=O)NS(=O)(=O)C1CC1] |

TABLE 16-continued
Exemplary NS3/NS4A protease inhibitors
| Description or Name(s) | Structure |
|---|---|
| MK-4519 | 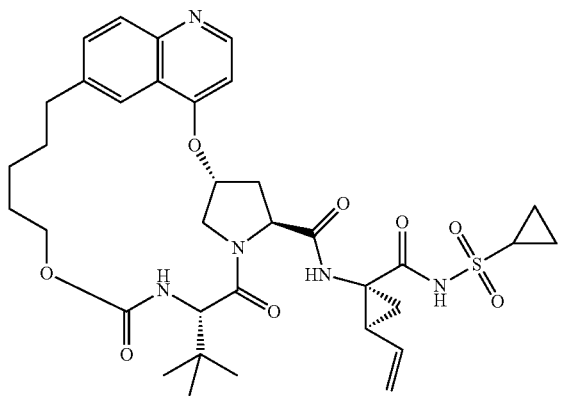 [SMILES: C=C[C@@H]1C[C@]1(NC(=O)[C@@H]1C[C@@H]2CN1C(=O)[C@H](C(C)(C)C)NC(=O)OCCCCCc1ccc3nccc(c3c1)O2)C(=O)NS(=O)(=O)C1CC1] |
| faldaprevir, BI-201335 | 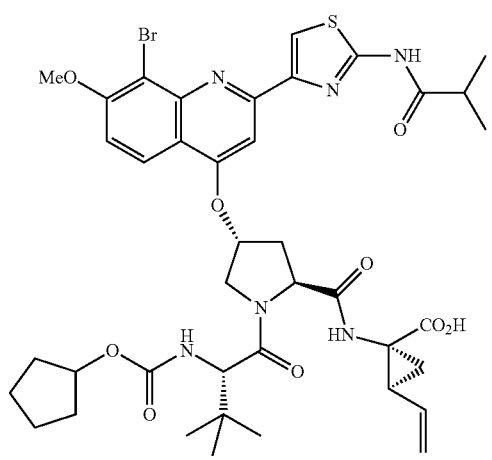 [SMILES: C=C[C@@H]1C[C@]1(NC(=O)[C@@H]1C[C@@H](Oc2cc(-c3csc(NC(=O)C(C)C)n3)nc3c(Br)c(OC)ccc23)CN1C(=O)[C@@H](NC(=O)OC1CCCC1)C(C)(C)C)C(=O)O] |
| Danoprevir, ITMN-191, R7227 | 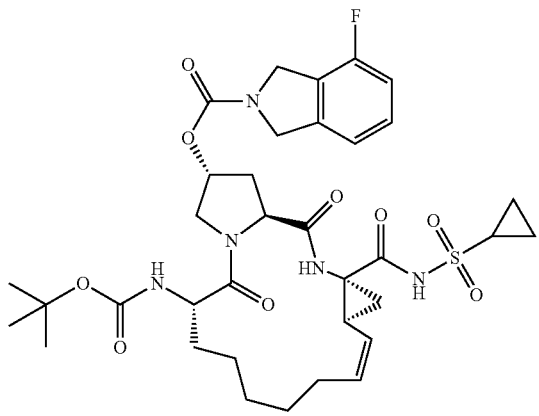 [SMILES: CC(C)(C)OC(=O)N[C@H]1CCCCC/C=C\[C@@H]2C[C@@]2(C(=O)NS(=O)(=O)C2CC2)NC(=O)[C@@H]2C[C@@H](OC(=O)N3Cc4cccc(F)c4C3)CN2C1=O] |

TABLE 16-continued

Exemplary NS3/NS4A protease inhibitors

| Description or Name(s) | Structure |
|---|---|
| SUNVEPRA™, asunaprevir, BMS-650032 | 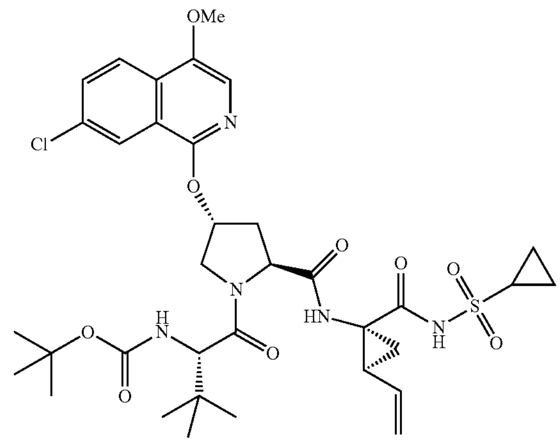 [SMILES: C=C[C@@H]1C[C@]1(NC(=O)[C@@H]1C[C@@H](Oc2ncc(OC)c3ccc(Cl)cc23)CN1C(=O)[C@@H](NC(=O)OC(C)(C)C)C(C)(C)C)C(=O)NS(=O)(=O)C1CC1] |
| VANIHEP™, vaniprevir, MK-7009 | 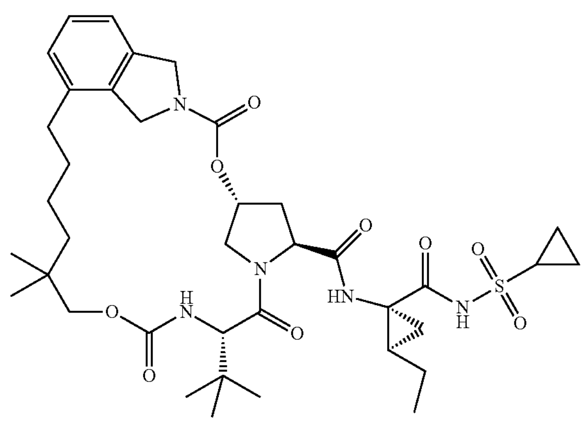 [SMILES: CC[C@@H]1C[C@]1(NC(=O)[C@@H]1C[C@@H]2CN1C(=O)[C@H](C(C)(C)C)NC(=O)OCC(C)(C)CCCCc1cccc3c1CN(C3)C(=O)O2)C(=O)NS(=O)(=O)C1CC1] |
| OLYSIO™, simeprevir, TMC-435350 | 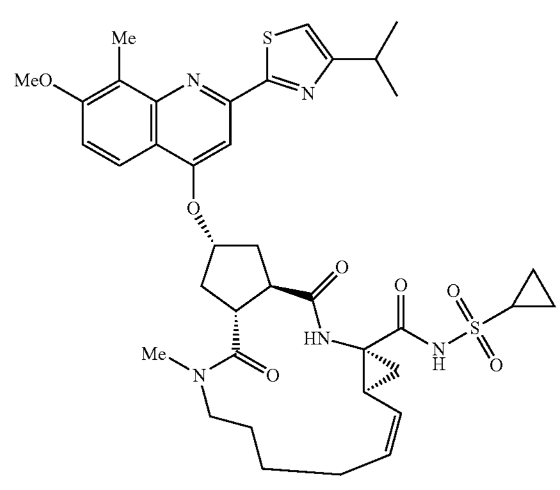 [SMILES: COc1ccc2c(O[C@@H]3C[C@H]4C(=O)N[C@]5(C(=O)NS(=O)(=O)C6CC6)C[C@H]5/C=C\CCCCN(C)C(=O)[C@@H]4C3)cc(-c3nc(C(C)C)cs3)nc2c1C] |

TABLE 16-continued

Exemplary NS3/NS4A protease inhibitors

| Description or Name(s) | Structure |
|---|---|
| Sovaprevir, ACH-1625 | 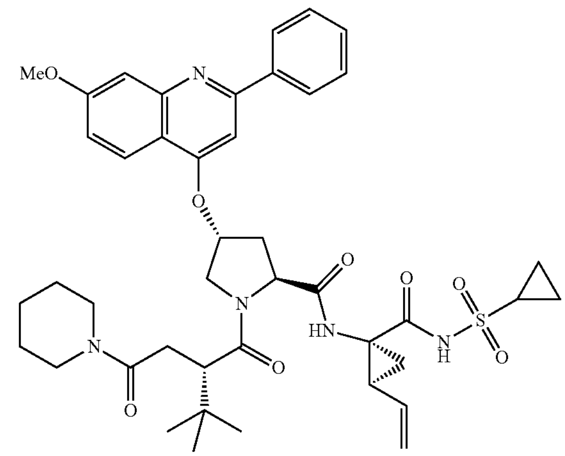 [SMILES: C=C[C@@H]1C[C@]1(NC(=O)[C@@H]1C[C@@H](Oc2cc(-c3ccccc3)nc3cc(OC)ccc23)CN1C(=O)[C@@H](CC(=O)N1CCCCC1)C(C)(C)C)C(=O)NS(=O)(=O)C1CC1] |
| Deldeprevir/neceprevir, ACH-2684 | 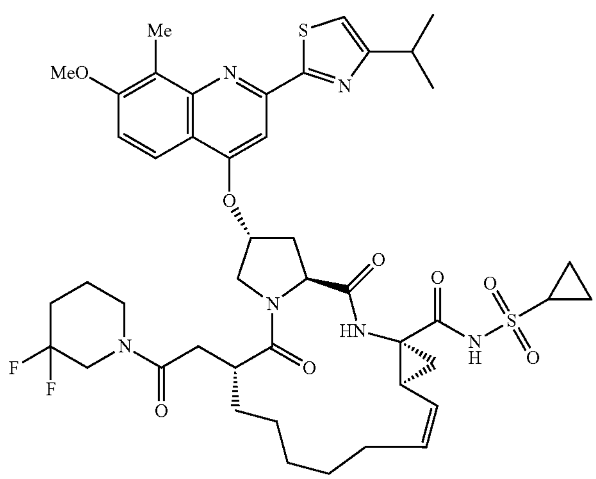 [SMILES: COc1ccc2c(O[C@@H]3C[C@H]4C(=O)N[C@]5(C(=O)NS(=O)(=O)C6CC6)C[C@H]5/C=C\CCCCC[C@H](CC(=O)N5CCCC(F)(F)C5)C(=O)N4C3)cc(-c3nc(C(C)C)cs3)nc2c1C] |
| IDX320 | 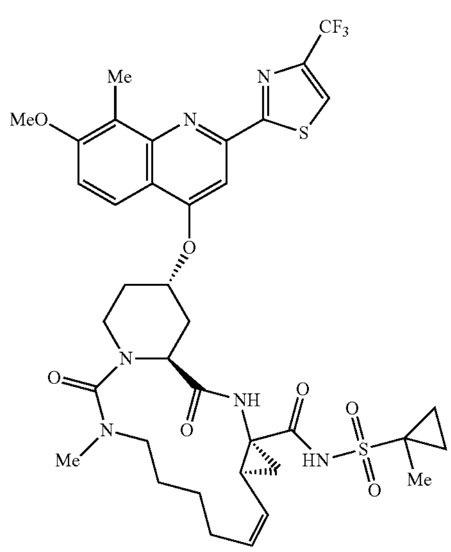 [SMILES: COc1ccc2c(O[C@H]3CCN4C(=O)N(C)CCCC/C=C\[C@@H]5C[C@@]5(C(=O)NS(=O)(=O)C5(C)CC5)NC(=O)[C@@H]4C3)cc(-c3nc(C(F)(F)F)cs3)nc2c1C] |

TABLE 16-continued
Exemplary NS3/NS4A protease inhibitors
| Description or Name(s) | Structure |
|---|---|
| GS-9256 | 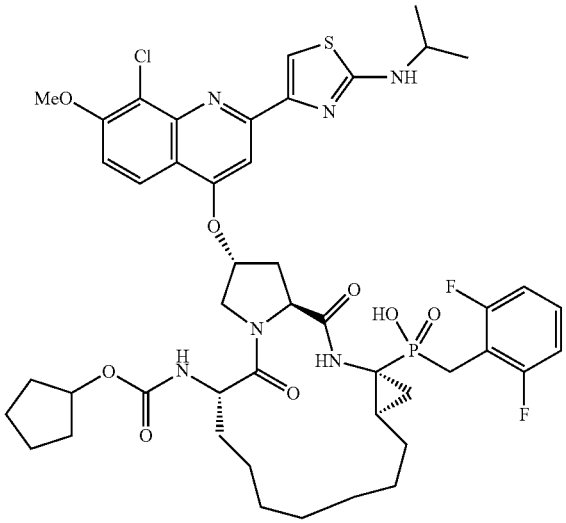 [SMILES: COc1ccc2c(O[C@@H]3C[C@H]4C(=O)N[C@]5(P(=O)(O)Cc6c(F)cccc6F)C[C@H]5CCCCCCC[C@H](NC(=O)OC5CCCC5)C(=O)N4C3)cc(-c3csc(NC(C)C)n3)nc2c1Cl] |
| PHX1766 | 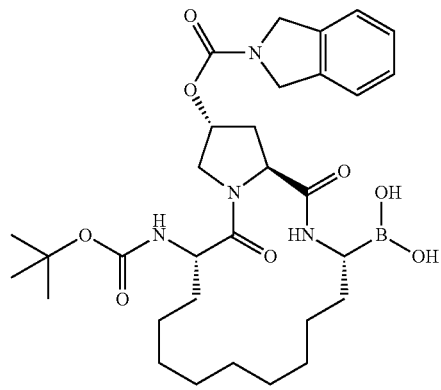 [SMILES: CC(C)(C)OC(=O)N[C@H]1CCCCCCCCC[C@@H](B(O)O)NC(=O)[C@@H]2C[C@@H](OC(=O)N3Cc4ccccc4C3)CN2C1=O] |
| MK-2748 | 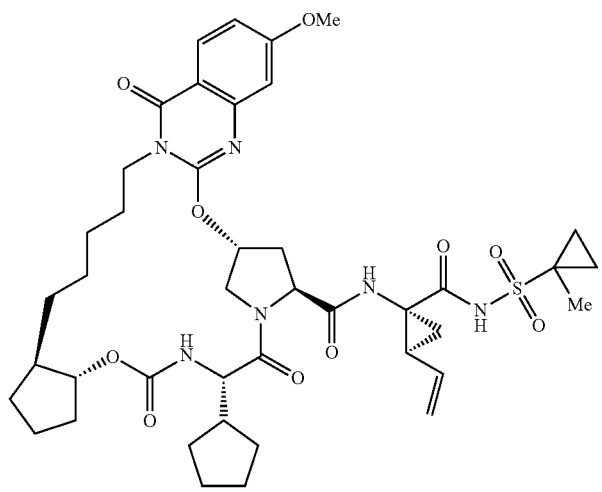 [SMILES: C=C[C@@H]1C[C@]1(NC(=O)[C@@H]1C[C@@H]2CN1C(=O)[C@H](C1CCCC1)NC(=O)O[C@@H]1CCC[C@H]1CCCCCn1c(nc3cc(OC)ccc3c1=O)O2)C(=O)NS(=O)(=O)C1(C)CC1] |

TABLE 16-continued

Exemplary NS3/NS4A protease inhibitors

| Description or Name(s) | Structure |
| --- | --- |
| Vedrorevir, GS-9451, GS-9451 | 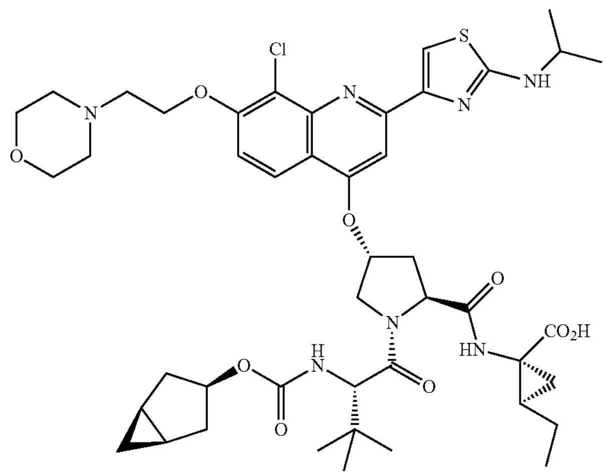 |
| MK-6325 | 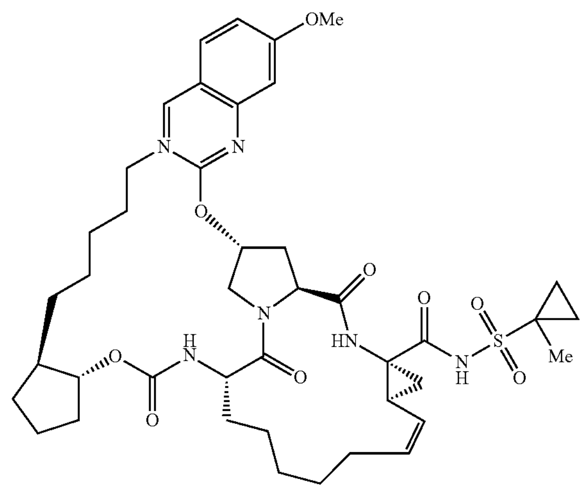 |
| MK-8831 | 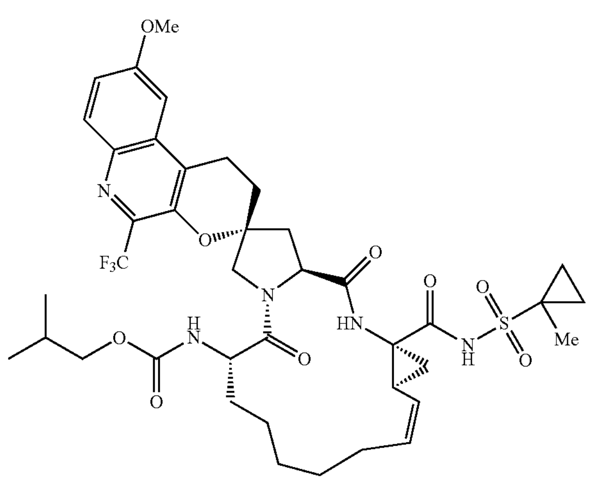 |

TABLE 16-continued

Exemplary NS3/NS4A protease inhibitors

| Description or Name(s) | Structure |
| --- | --- |
| VIKERA PAK ™, paritaprevir, ABT-450 | 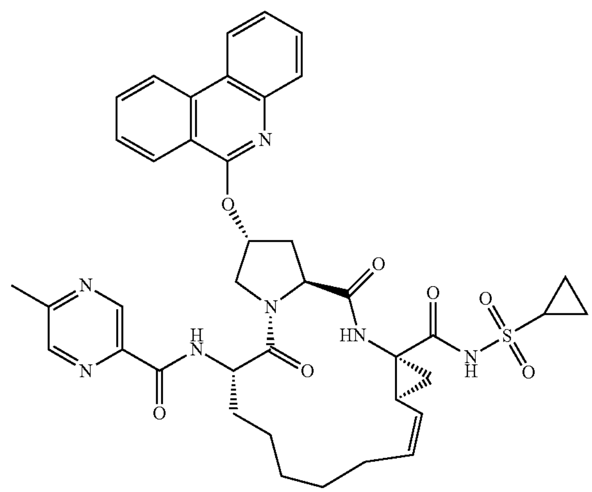 |
| ZEPATIER ™, grazoprevir, MK-5172 | 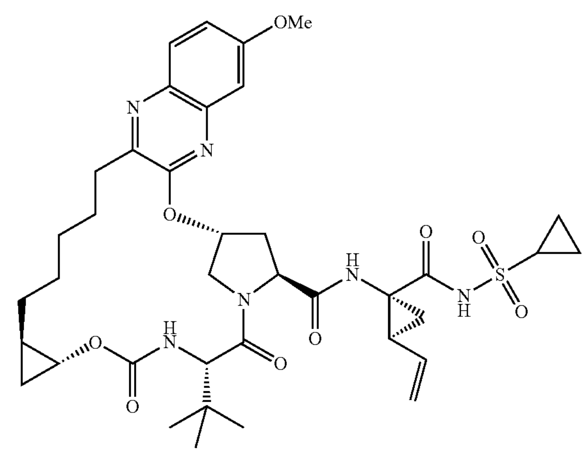 [SMILES: C=C[C@@H]1C[C@]1(NC(=O)[C@@H]1C[C@@H]2CN1C(=O)[C@H](C(C)(C)C)NC(=O)O[C@@H]1C[C@H]1CCCCCc1nc3ccc(OC)cc3nc1O2)C(=O)NS(=O)(=O)C1CC1] |
| Glecaprevir, ABT-493 | 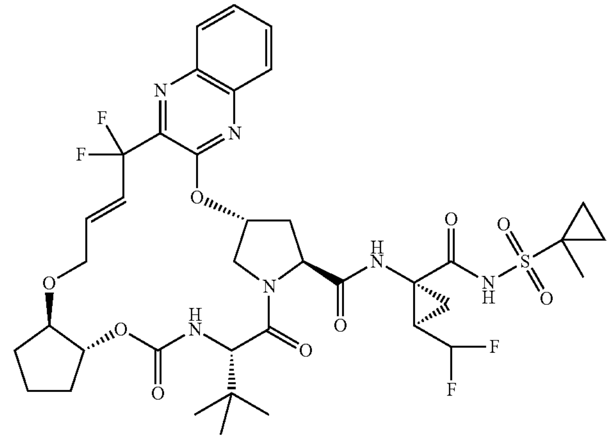 [SMILES: CC(C)(C)[C@@H]1NC(=O)O[C@@H]2CCC[C@H]2OC/C=C/C(F)(F)c2nc3ccccc3nc2O[C@@H]2C[C@@H](C(=O)N[C@]3(C(=O)NS(=O)(=O)C4(C)CC4)C[C@H]3C(F)F)N(C2)C1=O] |

TABLE 16-continued

Exemplary NS3/NS4A protease inhibitors

| Description or Name(s) | Structure |
|---|---|
| Voxilaprevir, GS-9857 | 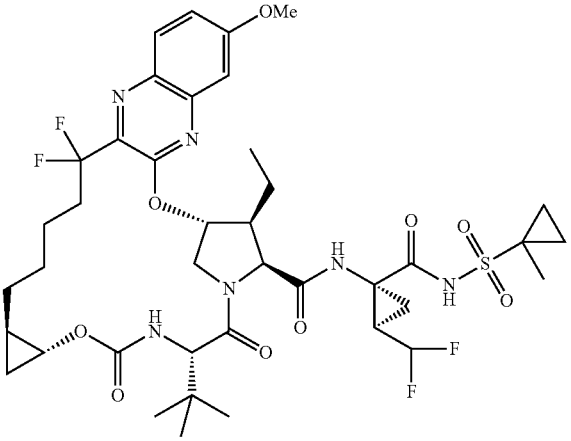 [SMILES: CC[C@@H]1[C@@H]2CN(C(=O)[C@H](C(C)(C)C)NC(=O)O[C@@H]3C[C@H]3CCCCC(F)(F)c3nc4ccc(OC)cc4nc3O2)[C@@H]1C(=O)N[C@]1(C(=O)NS(=O)(=O)C2(C)CC2)C[C@H]1C(F)F] |

In some embodiments of any of the aspects, a repressible protease as described herein is resistant to 1, 2, 3, 4, 5, or more different protease inhibitors as described herein. Non-limiting examples of NS3 amino acid substitutions conferring resistance to HCV NS3 protease inhibitors include: V36L (e.g., genotype 1b), V36M (e.g., genotype 2a), T54S (e.g., genotype 1b), Y56F (e.g., genotype 1b), Q80L (e.g., genotype 1b), Q80R (e.g., genotype 1b), Q80K (e.g., genotype 1a, 1b, 6a), Y132I (e.g., genotype 1b), A156S (e.g., genotype 2a), A156G, A156T, A156V, D168A (e.g., genotype 1b), I170V (e.g., genotype 1b), S20N, R26K, Q28R, A39T, Q41R, I71V, Q80R, Q86R, P89L, P89S, S101N, A111S, P115S, S122R, R155Q, L144F, A150V, R155W, V158L, D168A, D168G, D168H, D168N, D168V, D168E, D168Y, E176K, T178S, M179I, M179V, and M179T. See e.g., Sun et al., Gene Expr. 2018, 18(1): 63-69; Kliemann et al., World J Gastroenterol. 2016 Oct. 28, 22(40): 8910-8917; U.S. Pat. Nos. 7,208,309; 7,494,660; the contents of each of which are incorporated herein by reference in their entireties.

In some embodiments of any of the aspects, a CAR polypeptide as described herein comprises an NS3 protease comprising at least one resistance mutation as described herein or any combination thereof. In some embodiments of any of the aspects, a CAR polypeptide as described herein comprises an NS3 protease that is resistant to one protease inhibitor but responsive to at least one other protease inhibitor. In some embodiments of any of the aspects, a CAR system comprises: (a) a first CAR polypeptide comprising a repressible protease (e.g., NS3) that is resistant to a first protease inhibitor and that is susceptible to a second protease inhibitor; and (b) a second CAR polypeptide comprising a repressible protease (e.g., NS3) that is susceptible to a first protease inhibitor and that is resistant to a second protease inhibitor. Accordingly, presence of the first protease inhibitor can modulate the activity of the second CAR polypeptide but not the first CAR polypeptide, while the presence of the second protease inhibitor can modulate the activity of the first CAR polypeptide but not the second CAR polypeptide.

In some embodiments of any of the aspects, the repressible protease exhibits increased solubility compared to the wild-type protease. As a non-limiting example, the NS3 protease can comprise at least one of the following mutations or any combination thereof: Leu13 is substituted to Glu; Leu14 is substituted to Glu; Ile 17 is substituted to Gln; Ile 18 is substituted to Glu; and/or Leu21 is substituted to Gin. In some embodiments of any of the aspects, a CAR polypeptide as described herein comprises a repressible protease comprising SEQ ID NOs: 184-191, 205, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 184-191 or 205 that maintains the same functions (e.g., serine protease; increased solubility) as SEQ ID NOs: 184-191 or 205; see e.g., U.S. Pat. No. 6,333,186 and US Patent Publication US20020106642, the contents of each are incorporated herein by reference in their entireties. In some embodiments of any of the aspects, a CAR polypeptide as described herein comprises a repressible protease comprising SEQ ID NOs: 184-191, 205, or a sequence that is at least 95% identical to the sequence of one of SEQ ID NOs: 184-191 or 205 that maintains the same functions (e.g., serine protease; increased solubility) as SEQ ID NOs: 184-191 or 205.

```
SEQ ID NO: 184, soluble NS3, 182 aa
MAPITAYAQQTRGLLGCIITSLTGRDKNQVEGEVQIVSTAAQTFLATC

INGVCWTVYHGAGTRTIASPKGPVIQMYTNVDKDLVGWPAPQGSRSLT

PCTCGSSDLYLVTRHADVIPVRRRGDSRGSLLSPRPISYLKGSSGGPL

LCPAGHAVGIFRAAVCTRGVAKAVDFIPVESLETTMRS

SEQ ID NO: 185, soluble NS3/NS4A, 195 aa
MKKKGSVVIVGRIVLNGAYAQQTRGLLGCIITSLTGRDKNQVEGEVQI

VSTAAQTFLATCINGVCWTVYHGAGTRTIASPKGPVIQMYTNVDKDLV

GWPAPQGSRSLTPCTCGSSDLYLVTRHADVIPVRRRGDSRGSLLSPRP

ISYLKGSSGGPLLCPAGHAVGIFRAAVCTRGVAKAVDFIPVESLETTM

RSP
```

-continued

SEQ ID NO: 186, soluble NS3/NS4A, 195 aa
MKKKGSVVIVGRIVLNGAYAQQTRGEEGCQETSQTGRDKNQVEGEVQI

VSTAAQTFLATCINGVCWTVYHGAGTRTIASPKGPVIQMYTNVDKDLV

GWPAPQGSRSLTPCTCGSSDLYLVTRHADVIPVRRRGDSRGSLLSPRP

ISYLKGSSGGPLLCPAGHAVGIFRAAVCTRGVAKAVDFIPVESLETTM

RSP

SEQ ID NO: 187, soluble NS3/NS4A, 197 aa
MKKKGSVVIVGRINLSGDTAYAQQTRGEEGCQETSQTGRDKNQVEGEV

QIVSTAAQTFLATCINGVCWTVYHGAGTRTIASPKGPVIQMYTNVDKD

LVGWPAPQGSRSLTPCTCGSSDLYLVTRHADVIPVRRRGDSRGSLLSP

RPISYLKGSSGGPLLCPAGHAVGIFRAAVCTRGVAKAVDFIPVESLET

TMRSP

SEQ ID NO: 188, soluble NS3/NS4A, 197 aa
MKKKGSVVIVGRINLSGDTAYAQQTRGEEGCQETSQTGRDKNQVEGEV

QIVSTATQTFLATCINGVCWTVYHGAGTRTIASPKGPVTQMYTNVDKD

LVGWQAPQGSRSLTPCTCGSSDLYLVTRHADVIPVRRRGDSRGSLLSP

RPISYLKGSSGGPLLCPAGHAVGIFRAAVCTRGVAKAVDFIPVESLET

TMRSP

SEQ ID NO: 189, soluble NS3/NS4A, 197 aa
MKKKGSVVIVGRINLSGDTAYAQQTRGEEGCQETSQTGRDKNQVEGEV

QIVSTATQTFLATSINGVLWTVYHGAGTRTIASPKGPVTQMYTNVDKD

LVGWQAPQGSRSLTPCTCGSSDLYLVTRHADVIPVRRRGDSRGSLLSP

RPISYLKGSSGGPLLCPAGHAVGIFRAAVSTRGVAKAVDFIPVESLET

TMRSP

SEQ ID NO: 190, soluble NS3/NS4A, 197 aa
MKKKGSVVIVGRINLSGDTAYAQQTRGEQGCQKTSHTGRDKNQVEGEV

QIVSTATQTFLATSINGVLWTVYHGAGTRTIASPKGPVTQMYTNVDKD

LVGWQAPQGSRSLTPCTCGSSDLYLVTRHADVIPVRRRGDSRGSLLSP

RPISYLKGSSGGPLLCPAGHAVGIFRAAVSTRGVAKAVDFIPVESLET

TMRSP

SEQ ID NO: 191, soluble NS3/NS4A, 197 aa
MKKKGSVVIVGRINLSGDTAYAQQTRGEQGTQKTSHTGRDKNQVEGEV

QIVSTATQTFLATSINGVLWTVYHGAGTRTIASPKGPVTQMYTNVDKD

LVGWQAPQGSRSLTPCTCGSSDLYLVTRHADVIPVRRRGDSRGSLLSP

RPISYLKGSSGGPLLCPAGHAVGIFRAAVSTRGVAKAVDFIPVESLET

TMRSP

SEQ ID NO: 205, NS3aH1, soluble NS3/NS4A
(S139A), 196 aa
KKKGSVVIVGRINLSGDTAYAQQTRGEEGCQETSQTGRDKNQVEGEVQ

IVSTATQTFLATSINGVLWTVYHGAGTRTIASPKGPVTQMYTNVDKDL

VGWQAPQGSRSLTPCTCGSSDLYLVTRHADVIPVRRRGDSRGSLLSPR

PISYLKGSAGGPLLCPAGHAVGIFRAAVSTRGVAKAVDFIPVESLETT

MRSP

In some embodiments of any of the aspects, the repressible protease comprises mutations to increase binding affinity for a specific ligand. As a non-limiting example, NS3aH1 (e.g., SEQ ID NO: 205) comprises four mutations needed for interaction with the ANR peptide (e.g., SEQ ID NO: 204): A7S, E13L, 135V and T42S. Accordingly, in some embodiments of any of the aspects, a repressible protease as described herein comprises at least one of the following mutations: A7S, E13L, 135V and T42S, or any combination thereof.

In several aspects, described herein are CAR polypeptides comprising a degron domain. As used herein, the term "degron domain" refers to a sequence that promotes degradation of an attached protein, e.g., through the proteasome or autophagy-lysosome pathways; in some embodiments of any of the aspects, the terms "degron", "degradation domain" and "degradation domain" can be used interchangeably with "degron domain". In some embodiments, a degron domain is a polypeptide that destabilize a protein such that half-life of the protein is reduced at least two-fold, when fused to the protein. As a non-limiting example, an AND-gate CAR polypeptide can comprise a degron domain, as described herein. In some embodiments of any of the aspects, a CAR polypeptide as described herein (or a CAR polypeptide system collectively) comprises 1, 2, 3, 4, 5, or more degron domains. In some embodiments of any of the aspects, the CAR polypeptide or system comprises one degron domain. In embodiments comprising multiple degron domains, the multiple degron domains can be different individual degron domains or multiple copies of the same degron domain, or a combination of the foregoing.

Many different degron sequences/signals (e.g., of the ubiquitin-proteasome system) have been described, any of which can be used as provided herein. A degron domain may be operably linked to a cell receptor, but need not be contiguous or immediately adjacent with it as long as the degron domain still functions to direct degradation of the cell receptor. In some embodiments, the degron domain induces rapid degradation of the cell receptor. For a discussion of degron domains and their function in protein degradation, see, e.g., Kanemaki et al. (2013) Pflugers Arch. 465(3):419-425, Erales et al. (2014) Biochim Biophys Acta 1843(1):216-221, Schrader et al. (2009) Nat. Chem. Biol. 5(11): 815-822, Ravid et al. (2008) Nat. Rev. Mol. Cell. Biol. 9(9):679-690, Tasaki et al. (2007) Trends Biochem Sci. 32(11):520-528, Meinnel et al. (2006) Biol. Chem. 387(7): 839-851, Kim et al. (2013) Autophagy 9(7): 1100-1103, Varshavsky (2012) Methods Mol. Biol. 832: 1-11, and Fayadat et al. (2003) Mol Biol Cell. 14(3): 1268-1278; Chassin et al., Nature Communications volume 10, Article number: 2013 (2019); Natsume and Kanemaki Annu Rev Genet. 2017 Nov. 27,51:83-102; the contents of each of which is incorporated herein by reference in its entirety.

In some embodiments of any of the aspects, the degron domain comprises a ubiquitin tag, including but not limited to: UbR, UbP, UbW, UbH, UbI, UbK, UbQ, UbV, UbL, UbD, UbN, UbG, UbY, UbT, UbS, UbF, UbA, UbC, UbE, UbM, 3×UbVR, 3×UbVV, 2×UbVR, 2×UbVV, UbAR, UbVV, UbVR, UbAV, 2×UbAR, 2×UbAV. In some embodiments of any of the aspects, the degron domain comprises a self-excising degron, which refers to a complex comprising a repressible protease, a protease cleavage site, and a degron domain. In some embodiments of any of the aspects, the degron domain is a conditional degron domain, wherein the degradation is induced by ligands (e.g., a degron stabilizer) or another input such as temperature shift or a specific wave length of light. Non-limiting examples of conditional degron domains include the eDHFR degron (e.g., TMP inducer); FKBP12 (e.g., rapamycin analog inducer); temperature-sensitive dihydrofolate reductase (R-DHFRts, or ts-DHFR);

a modified version of R-DHFRts termed the low-temperature degron (lt-degron); auxin-inducible degradation (AID); HaloTag-Hydrophobic Tag, HaloPROTAC, and dTAG system (e.g., HyT13 or HyT36 inducer); photosensitive degron (PSD); blue-light-inducible degron (B-LID); tobacco etch virus (TEV) protease-induced protein inactivation (TIPI)-degron system; deGradFP (degrade green fluorescent protein; e.g., induced by NSlmb-vhhGFP expression); or split ubiquitin for the rescue of function (SURF; e.g., induced by rapamycin).

In some embodiments of any of the aspects, the degron domain comprises a destabilizing domain (DD). Proteins comprising a destabilizing domain are destabilized and constitutively degraded. In some embodiments of any of the aspects, the destabilizing domain of a degron domain can bind to a degron stabilizer, such that destabilizing degron domain is not active and no longer promotes the degradation of the attached protein. The system is reversible and when the degron stabilizer is withdrawn, the protein is degraded again. In some embodiments of any of the aspects, a CAR polypeptide is bound to a degron stabilizer bound to the degron domain. In some embodiments of any of the aspects, the CAR polypeptide is bound specifically to a degron stabilizer bound to the degron domain.

In some embodiments of any of the aspects, the CAR polypeptide is in combination with 1, 2, 3, 4, 5, or more degron stabilizers. In some embodiments of any of the aspects, the CAR polypeptide is in combination with one degron stabilizer. In embodiments comprising multiple degron stabilizers, the multiple degron stabilizers can be different individual degron stabilizers or multiple copies of the same degron stabilizer, or a combination of the foregoing.

In some embodiments of any of the aspects, the degron domain is the *E. coli* dihydrofolate reductase (eDHFR) degron. The eDHFR degron permits extensive depletion of exogenously expressed proteins in mammalian cells and *C. elegans*. The eDHFR degron is stabilized by tight binding to the antibiotic and degron stabilizer trimethoprim (TMP), shown below, which is innocuous in eukaryotic cells.

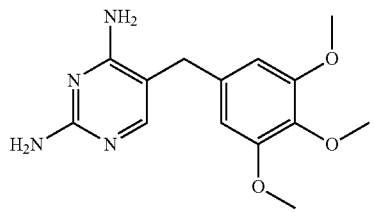 [SMILES: COc1cc(Cc2cnc(N)nc2N)cc(OC)c1OC]

Proteins tagged with eDHFR are constitutively degraded unless the cells are exposed to TMP. The level of tagged protein can be directly controlled by modulating the TMP concentration in the growth medium. Unlike shRNA methods this degron-based strategy is advantageous since depletion kinetics are not limited by the natural protein half-life, which allows for more rapid knockdown of stable proteins. TMP stabilizes the DD-target protein fusion in a dose-dependent manner up to 100-fold, which gives the system a substantial dynamic range. The ligand TMP works by itself and does not require dimerization with a second protein. This system is so effective that it can control the levels of transmembrane proteins, such as the CAR polypeptides described herein; see e.g., Schrader et al., Chem Biol. 2010 Sep. 24, 17(9): 917-918; Ryan M. Sheridan and David L. Bentley, Biotechniques. 2016, 60(2): 69-74.

In some embodiments of any of the aspects, the degron domain comprises an amino acid sequence derived from an FK506- and rapamycin-binding protein (FKBP12) (UniProtKB—P62942 (FKB 1A_HUMAN), incorporated herein by reference), or a variant thereof. In some embodiments of any of the aspects, the FKBP12 derived amino acid sequence comprises a mutation of the phenylalanine (F) at amino acid position 36 (as counted without the methionine) to valine (V) (F36V) (also referred to as FKBP12* or FKBP*). In some embodiments of any of the aspects, the degron stabilizer is a rapamycin analog, such as Sheild-1, shown below. See e.g., Banaszynski et al., Cell. 2006 Sep. 8; 126(5): 995-1004; US Patent Application US20180179522; U.S. Pat. No. 10,137,180; the content of each of which is incorporated herein by reference in its entirety.

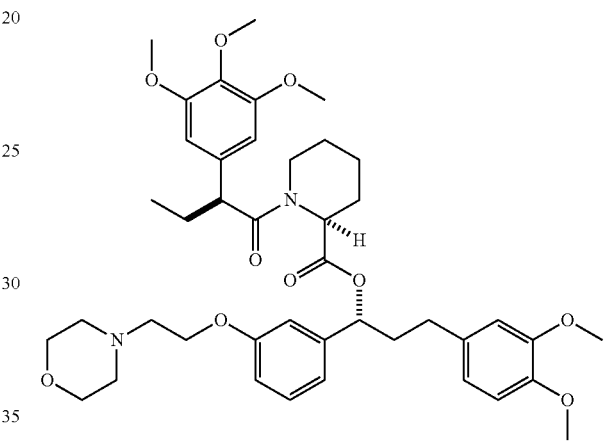

In some embodiments of any of the aspects, the degron domain of a CAR polypeptide as described herein comprises SEQ ID NOs: 59, 262, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NOs: 59 or 262 that maintains the same functions as SEQ ID NOs: 59 or 262 (e.g., degradation, binding to TMP or Shield-1). In some embodiments of any of the aspects, the degron domain of a CAR polypeptide as described herein comprises SEQ ID NOs: 59 or 262 or an amino acid sequence that is at least 95% identical to the sequence of SEQ ID NOs: 59 or 262 that maintains the same functions as SEQ ID NOs: 59 or 262 (e.g., degradation, binding to TMP or Shield-1).

In some embodiments of any of the aspects, the degron domain of a CAR polypeptide as described herein is encoded by a nucleic acid sequence comprising SEQ ID NO: 26 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 26 that maintains the same function or a codon-optimized version of SEQ ID NO: 26. In some embodiments of any of the aspects, the degron domain of a CAR polypeptide as described herein is encoded by a nucleic acid sequence comprising SEQ ID NO: 26 or a sequence that is at least 95% identical to SEQ ID NO: 26 that maintains the same function.

SEQ ID NO: 26, DHFR (V19A), 474 nt
ATCAGTCTGATTGCGGCGTTAGCGGTAGATTACGTTATCGGCATGGAA

AACGCCATGCCGTGGAACCTGCCTGCCGATCTCGCCTGGTTTAAACGC

AACACCTTAAATAAACCCGTGATTATGGGCCGCCATACCTGGGAATCA

ATCGGTCGTCCGTTGCCAGGACGCAAAAATATTATCCTCAGCAGTCAA

CCGAGTACGGACGATCGCGTAACGTGGGTGAAGTCGGTGGATGAAGCC

ATCGCGGCGTGTGGTGACGTACCAGAAATCATGGTGATTGGCGGCGGT

CGCGTTATTGAACAGTTCTTGCCAAAAGCGCAAAAACTGTATCTGACG

CATATCGACGCAGAAGTGGAAGGCGACACCCATTTCCCGGATTACGAG

CCGGATGACTGGGAATCGGTATTCAGCGAGTTCCACGATGCTGATGCG

CAGAACTCTCACAGCTATTGCTTTGAGATTCTGGAGCGGCGA

SEQ ID NO: 59, DHFR (V19A), 158 aa,
ISLIAALAVDYVIGMENAMPWNLPADLAWFKRNTLNKPVIMGRHTWES

IGRPLPGRKNIILSSQPSTDDRVTWVKSVDEAIAACGDVPEIMVIGGG

RVIEQFLPKAQKLYLTHIDAEVEGDTHFPDYEPDDWESVFSEFHDADA

QNSHSYCFEILERR

SEQ ID NO: 262, FK506- and rapamycin-binding
protein (FKBP), 107 aa
GVQVETISPGDGRTFPKRGQTCVVHYTGMLEDGKKFDSSRDRNKPFKF

MLGKQEVIRGWEEGVAQMSVGQRAKLTISPDYAYGATGHPGIIPPHAT

LVFDVELLKLE

In some embodiments of any of the aspects, the destabilizing degron domain comprises at least one mutation that causes almost complete removal or degradation of the CAR polypeptide. Non-limiting examples of DHFR (e.g., SEQ ID NO: 59) mutations include: V19A, Y100I, G121V, H12Y, H12L, R98H, F103S, M42T, H114R, I61F, T68S, H12Y/Y100I, H12L/Y100I, R98H/F103S, M42T/H114R, and I61F/T68S, or any combinations thereof, see e.g., U.S. Pat. No. 8,173,792, the content of which is incorporated herein by reference in its entirety.

In some embodiments of any of the aspects, the degron domain comprises a ligand-induced degradation (LID) domain. Proteins comprising a LID domain are destabilized and degraded in the presence of a degron destabilizer. In some embodiments of any of the aspects, the LID domain of a degron domain can bind to a degron destabilizer, promoting the degradation of the attached protein. The system is reversible and when the degron destabilizer is withdrawn, the protein is not destabilized and/or not degraded. In some embodiments of any of the aspects, a CAR polypeptide is bound to a degron destabilizer bound to the degron domain. In some embodiments of any of the aspects, the CAR polypeptide is bound specifically to a degron destabilizer bound to the degron domain.

In some embodiments of any of the aspects, the CAR polypeptide is in combination with 1, 2, 3, 4, 5, or more degron destabilizers. In some embodiments of any of the aspects, the CAR polypeptide is in combination with one degron destabilizer. In embodiments comprising multiple degron destabilizers, the multiple degron destabilizers can be different individual degron destabilizers or multiple copies of the same degron stabilizer, or a combination of the foregoing.

In some embodiments of any of the aspects, the LID degron domain comprises the FK506- and rapamycin-binding protein (FKBP), further comprising a degron fused to the C terminus of FKBP, e.g., with an intervening linker such as the 10-amino acid linker (Gly4SerGly4Ser (SEQ ID NO: 270)) or another linker as described herein. In some embodiments of any of the aspects, the degron fused to the C terminus of FKBP (e.g., SEQ ID NO: 262) comprises the 19 amino acid sequence: TRGVEEVAEGVVLLRRRGN (SEQ ID NO: 263), or a sequence that is at least 95% identical that maintains the same function. In the absence of the small molecule Shield-1, the 19-aa degron is bound to the FKBP fusion protein, and the protein is stable. When present, Shield-1 binds tightly to FKBP, displacing the 19-aa degron and inducing rapid and processive degradation of the LID domain and any fused partner protein. In some embodiments of any of the aspects, the degron destabilizer is Sheild-1, shown above, or an analog thereof; see e.g., Bonger et al., Nat Chem Biol. 2011 Jul. 3; 7(8):531-7.

In several aspects, described herein are CAR polypeptides comprising a peptide domain. As used herein, the term "peptide domain" refers to a short polypeptide domain that can specifically bind to a repressible protease as described herein (e.g., NS3 protease). The peptide domain can also be referred to herein as a "protease-binding domain". In some embodiments of any of the aspects, any peptide that can bind to the repressible protease can be used. In some embodiments of any of the aspects, the peptide domain comprises a protease cleavage site as described herein and is a substrate peptidomimetic. In some embodiments of any of the aspects, the peptide domain is specifically bound by but not cleaved by the repressible protease. As a non-limiting example, an OFF-switch CAR polypeptide as described herein can comprise a peptide domain. In some embodiments of any of the aspects, a CAR polypeptide as described herein (or a CAR polypeptide system collectively) comprises 1, 2, 3, 4, 5, or more peptide domains. In some embodiments of any of the aspects, the CAR polypeptide or system comprises one peptide domain. In embodiments comprising multiple peptide domains, the multiple peptide domains can be different individual peptide domains or multiple copies of the same peptide domain, or a combination of the foregoing.

Table 17 lists non-limiting examples of peptide domains (e.g., for NS3 protease). Such inhibitory peptides cap the active site and bind via a "tyrosine" finger at an alternative NS3-4A site. The peptides are not cleaved due to a combination of geometrical constraints and impairment of the oxyanion hole function. Negligible susceptibility to known (e.g., A156V and R155K) resistance mutations of the NS3-4A protease have been observed. Accordingly, non-limiting examples of peptide domains include: K5-66, K5-66-A, K5-66-B, K6-10, K6-10A, K6-10B K5-66-R, CP5-46, CP5-46-4D5E, CP5-46-A, CP5-46A-4D5E, Ant-CP5-46A-4D5E, and apo NS3a reader (ANR) peptides (see e.g., Kugler et al., High Affinity Peptide Inhibitors of the Hepatitis C Virus NS3-4A Protease Refractory to Common Resistant Mutants, J Biol Chem. 2012 Nov. 9; 287(46): 39224-39232; Cunningham-Bryant et al., J Am Chem Soc. 2019 Feb. 27; 141(8):3352-3355).

TABLE 17

Exemplary Peptide Domains

| SEQ ID NO: | Peptide | Sequence |
| --- | --- | --- |
| 192 | K5-66 | GELGRLVYLLDGPGYDPIHC SLAYGDASTLVVF |

TABLE 17-continued

Exemplary Peptide Domains

| SEQ ID NO: | Peptide | Sequence |
|---|---|---|
| 193 | K5-66-A | GELGRLVYLLDGPGYDPI |
| 194 | K5-66-B | HCSLAYGDASTLVVF |
| 195 | K6-10 | GELGRPVYVLGDPGYYATHC IYATTNDALIFSV |
| 196 | K6-10-A | GELGRPVYVLGDPGYYAT |
| 197 | K6-10-B | HCIYATTNDALIFSV |
| 198 | K5-66-R | GELGRIPSDTYDLAVGALH CPFYLVSGLVYLDG |
| 199 | CPS-46 | GELGRLVYLLDGPGYDPIHC DVVTRGGSHLFNF |
| 200 | CP5-46-4D5E | GELDELVYLLDGPGYDPIHC DVVTRGGSHLFNF |
| 201 | CPS-46-A | GELGRLVYLLDGPGYDPIHCD |
| 202 | CP5-46A-4D5E | GELDELVYLLDGPGYDPIHS |
| 203 | Ant-CPS-46A-4D5E | RQIK IWFQNRRMKWKKGEL DELVYLLDGPGYDPIHS |
| 204 | ANR | GELDELVYLLDGPGYDPIHSD |

In some embodiments of any of the aspects, the peptide domain of a CAR polypeptide as described herein comprises SEQ ID NOs: 95, 192-204, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 95, 192-204, that maintains the same functions as one of SEQ ID NOs: 95, 192-204 (e.g., binding to a repressible protease). In some embodiments of any of the aspects, the peptide domain of a CAR polypeptide as described herein comprises SEQ ID NOs: 95, 192-204, or an amino acid sequence that is at least 95% identical to the sequence of one of SEQ ID NOs: 95, 192-204, that maintains the same functions as one of SEQ ID NOs: 95, 192-204.

In some embodiments of any of the aspects, the peptide domain of a CAR polypeptide as described herein is encoded by a nucleic acid sequence comprising SEQ ID NO: 71 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 71 that maintains the same function or a codon-optimized version of SEQ ID NO: 71. In some embodiments of any of the aspects, the peptide domain of a CAR polypeptide as described herein is encoded by a nucleic acid sequence comprising SEQ ID NO: 71 or a sequence that is at least 95% identical to SEQ ID NO: 71 that maintains the same function.

SEQ ID NO: 71, CP5-46-5D5E, 99 nt
GGAGAACTTGATGAATTGGTATACTTACTAGATGGGCCAGGTTATGAC

CCTATACATTGCGATGTAGTGACAAGGGGCGGCAGCCACCTTTTCAAT

TTT

SEQ ID NO: 95, CP5-46-5D5E, 33 aa:
GELDELVYLLDGPGYDPIHCDVVTRGGSHLFNF

In some embodiments of any of the aspects, a peptide domain is specific for a certain genotype of repressible protease. As a non-limiting example, the peptide ANR (e.g., SEQ ID NO: 204) was selected to interact with genotype 1b NS3a (e.g., SEQ ID NO: 99) or an NS3 comprising the following mutations: A7S, E13L, I135V and T42S (e.g., SEQ ID NO: 205). Apo NS3a reader (ANR) forms a basal complex with NS3a-genotype 1b with an affinity of 10 nM, which is disrupted by NS3a-targeting drugs. Accordingly, described herein are systems comprising a peptide domain (e.g., SEQ ID NO: 95, 192-204) and a repressible protease (e.g., SEQ ID NO: 99, 205).

In several aspects, described herein are CAR polypeptides comprising a reader domain (e.g., reader CAR polypeptides as described herein). As used herein, the term "reader domain" refers to a polypeptide sequence that specifically binds to a repressible protease as described herein in the presence of a specific protease inhibitor. As a non-limiting example, a reader CAR polypeptide as described herein can comprise a reader domain. In some embodiments of any of the aspects, a CAR polypeptide as described herein (or a CAR polypeptide system collectively) comprises 1, 2, 3, 4, 5, or more reader domains. In some embodiments of any of the aspects, the CAR polypeptide or system comprises one reader domain. In embodiments comprising multiple reader domains, the multiple reader domains can be different individual reader domains or multiple copies of the same reader domain, or a combination of the foregoing.

In some embodiments of any of the aspects, a CAR polypeptide as described herein comprises a reader domain that recognizes a specific inhibitor-bound state of the HCV NS3 repressible protease. As a non-limiting example, the reader domain can specifically bind to at least one of the following protease inhibitors: grazoprevir, danoprevir, simeprevir, asunaprevir, ciluprevir, boceprevir, sovaprevir, paritaprevir, ombitasvir, paritaprevir, ritonavir, dasabuvir, telaprevir, or a protease inhibitor selected from Table 16. In some embodiments of any of the aspects, the reader domain comprises the scaffold of leucine-rich repeat proteins (LRRs), designed helical repeat proteins (DHRs), ferredoxins and/or helical bundles, that has been designed to specifically bind to a specific protease inhibitor in combination with a repressible protease; see e.g., Foight et al., Nat Biotechnol. 2019 October; 37(10):1209-1216, the content of which is incorporated herein by reference in its entirety. In some embodiments of any of the aspects, the CAR polypeptide is bound to a protease inhibitor bound to the reader domain. In some embodiments of any of the aspects, the CAR polypeptide is bound specifically to a protease inhibitor bound to the reader domain.

In some embodiments of any of the aspects, the CAR polypeptide comprising a reader domain is in combination with 1, 2, 3, 4, 5, or more protease inhibitors. In some embodiments of any of the aspects, the CAR polypeptide comprising a reader domain is in combination with one protease inhibitor. In embodiments comprising multiple protease inhibitors, the multiple protease inhibitors can be different individual protease inhibitors or multiple copies of the same protease inhibitor, or a combination of the foregoing.

In some embodiments of any of the aspects, the reader domain comprises a danoprevir/NS3 complex reader (DNCR). Non-limiting examples of DNCRs include D3, DNCR1, and DNCR2. In some embodiments of any of the aspects, the reader domain comprises DNCR2 (e.g., SEQ ID NO: 101), which has an affinity for the NS3a/danoprevir complex of 36 pM, and no detectable binding to apo NS3a and >20,000-fold selectivity over NS3a bound to the drugs grazoprevir or asunaprevir. DNCR2 does not bind substantially to free danoprevir. DNCR2/danoprevir/NS3a forms a 1:1:1 complex.

In some embodiments of any of the aspects, the reader domain comprises a grazoprevir/NS3 complex reader (GNCR). Non-limiting examples of GNCRs include GNCR1 and G3. In some embodiments of any of the aspects, the reader domain comprises GNCR1 (e.g., SEQ ID NO: 105), which demonstrates an affinity for the grazoprevir/NS3a complex of 140 nM and little to no affinity for apo, danoprevir-bound or asunaprevir-bound NS3a.

In some embodiments of any of the aspects, the reader domain comprises D5 (e.g., SEQ ID NO: 206), which demonstrates moderate binding of NS3 in the presence of danoprevir or grazoprevir and some binding of NS3 in the presence of asunaprevir. In some embodiments of any of the aspects, the reader domain comprises DNCR1 (e.g., SEQ ID NO: 207), which demonstrates high binding of NS3 in the presence of danoprevir and minimal binding of NS3 in the presence of asunaprevir or grazoprevir. In some embodiments of any of the aspects, the reader domain comprises G5 (e.g., SEQ ID NO: 208), which demonstrates moderate binding of NS3 in the presence of grazoprevir, some binding of NS3 in the presence of asunaprevir, and no binding to NS3 in the presence of danoprevir. In some embodiments of any of the aspects, the reader domain comprises a asunaprevir/NS3 complex reader, including but not limited to D5 and G3.

In some embodiments of any of the aspects, the reader domain of a CAR polypeptide as described herein comprises SEQ ID NOs: 101, 105, 206-208, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 101, 105, or 206-208 that maintains the same functions as one of SEQ ID NOs: 101, 105, or 206-208 (e.g., binding to a repressible protease in the presence of a specific protease inhibitor). In some embodiments of any of the aspects, the reader domain of a CAR polypeptide as described herein comprises SEQ ID NOs: 101, 105, 206-208, or an amino acid sequence that is at least 95% identical to the sequence of one of SEQ ID NOs: 101, 105, or 206-208 that maintains the same functions as one of SEQ ID NOs: 101, 105, or 206-208.

In some embodiments of any of the aspects, the reader domain of a CAR polypeptide as described herein is encoded by a nucleic sequence comprising SEQ ID NO: 77, 81 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NOs: 77 or 81 that maintains the same function or a codon-optimized version of SEQ ID NOs: 77 or 81. In some embodiments of any of the aspects, the reader domain of a CAR polypeptide as described herein is encoded by a nucleic sequence comprising SEQ ID NOs: 77, 81 or a sequence that is at least 95% identical to SEQ ID NOs: 77 or 81 that maintains the same function.

```
SEQ ID NO: 77, DNCR2, 687 nt
TCTTCCGACGAAGAAGAAGCGCGCGAGCTGATCGAGCGTGCGAAGGAG

GCTGCGGAACGCGCGCAAGAAGCTGCTGAGCGTACCGGTGATCCGCGC

GTGCGTGAACTCGCTCGTGAGCTGAAACGCCTGGCTCAGGAAGCTGCT

GAAGAAGTGAAGCGTGACCCGTCTTCCTCCGATGTGAACGAAGCGCTC

AAACTCATCGTGGAAGCTATCGAGGCGGCTGTGGACGCGCTCGAAGCG

GCTGAACGCACCGGCGACCCGGAGGTTCGTGAGCTGGCGCGTGAGCTC

GTGCGCCTCGCGGTTGAGGCTGCGGAGGAGGTGCAACGTAACCCATCC

TCCTCTGACGTGAATGAGGCTCTCCACAGCATAGTTTACGCTATTGAA

GCTGCCATTTTTGCATTGGAAGCTGCCGAAAGGACTGGTGACCCGGAA

GTGAGAGAACTCGCCCGAGAGCTTGTAAGACTGGCGGTTGAGGCGGCT

GAAGAAGTCCAGCGAAATCCGTCCAGCCGGAATGTCGAGCACGCACTG

ATGAGGATTGTGTTGGCCATTTACCTGGCAGAAGAAAATCTCCGCGAA

GCTGAGGAGTCTGGCGATCCGGAAAAACGTGAAAAGGCTCGCGAACGT

GTTCGTGAGGCGGTGGAACGTGCGGAAGAGGTTCAGCGTGATCCATCC

GGTTGGCTGAATCAT

SEQ ID NO: 81, GNCR1, 699 nt
GATATCGAGAAGCTTTGCAAAAAAGCTGAAGAAGAGGCAAAGGAGGCG

CAAGAGAAAGCTGATGAGTTGCGGCAACGGCACCCCGACAGCCAGGCT

GCTGAGGATGCTGAGGACTTGGCAAATCTGGCGGTGGCCGCTGTCTTG

ACGGCTTGCTTGTTGGCCCAAGAACATCCAAACGCTGACATTGCAAAG

CTTTGCATTAAGGCCGCGTCCGAAGCGGCTGAAGCAGCTTCTAAGGCA

GCCGAGCTGGCGCAACGGCATCCTGACTCCCAAGCGGCGAGGGACGCT

ATAAAACTCGCATCACAAGCAGCCAGAGCTGTAATCCTCGCTATTATG

CTCGCAGCCGAAAACCCAAACGCTGATATTGCCAAACTGTGTATAAAG

GCGGCTAGTGAAGCCGCAGAAGCTGCAAGCAAAGCAGCAGAACTTGCC

CAACGCCACCCCGACTCCCAGGCGGCTAGAGATGCTATAAAACTTGCT

TCTCAGGCTGCGGAGGCGGTAGAACGAGCGATCTGGCTGGCAGCAGAG

AACCCCAACGCTGACATTGCCAAAAAGTGTATCAAGGCGGCTTCCGAA

GCCGCCGAGGAGGCCAGCAAAGCGGCGGAAGAGGCACAGAGACATCCG

GACTCACAGAAAGCACGCGACGAGATTAAAGAGGCTAGTCAAAAAGCA

GAGGAGGTAAAAGAACGCTGTAAGTCC

SEQ ID NO: 101, DNCR2, 229 aa
SSDEEEARELIERAKEAAERAQEAAERTGDPRVRELARELKRLAQEAA

EEVKRDPSSSDVNEALKLIVEAIEAAVDALEAAERTGDPEVRELAREL

VRLAVEAAEEVQRNPSSSDVNEALHSIVYAIEAAIFALEAAERTGDPE

VRELARELVRLAVEAAEEVQRNPSSRNVEHALMRIVLAIYLAEENLRE

AEESGDPEKREKARERVREAVERAEEVQRDPSGWLNH
```

SEQ ID NO: 105, GNCR1, 233 aa:
DIEKLCKKAEEEAKEAQEKADELRQRHPDSQAAEDAEDLANLAVAAVL

TACLLAQEHPNADIAKLCIKAASEAAEAASKAAELAQRHPDSQAARDA

IKLASQAARAVILAIMLAAENPNADIAKLCIKAASEAAEAASKAAELA

QRHPDSQAARDAIKLASQAAEAVERAIWLAAENPNADIAKKCIKAASE

AAEEASKAAEEAQRHPDSQKARDEIKEASQKAEEVKERCKS

SEQ ID NO: 206, D5, 229 aa
SSDEEEARELIERAKEAAERAQEAAERTGDPRVRELARELKRLAQEAA

EEVKRDPSSSDVNEALKLIVEAIEAAVDALEAAERTGDPEVRELAREL

VRLAVEAAEEVQRNPSSSDVNEALLTIVIAIEAAVNALEAAERTGDPE

VRELARELVRLAVEAAEEVQRNPSSREVNIALWKIVLAIQEAVESLRE

AEESGDPEKREKARERVREAVERAEEVQRDPSGWLNH

SEQ ID NO: 207, DNCR1, 229 aa
SSDEEEARELIERAKEAAERAQEAAERTGDPRVRELARELKRLAQEAA

EEVKRDPSSSDVNEALKLIVEAIEAAVDALEAAERTGDPEVRELAREL

VRLAVEAAEEVQRNPSSSDVNEALLSIVIAIEAAVHALEAAERTGDPE

VRELARELVRLAVEAAEEVQRNPSSREVEHALMKIVLAIYEAEESLRE

AEESGDPEKREKARERVREAVERAEEVQRDPSGWLNH

SEQ ID NO: 208, G3, 233 aa
DIEKLCKKAEEEAKEAQEKADELRQRHPDSQAAEDAEDLANEAEAAVL

AACSLAQEHPNADIAKLCIKAASEAAEAASKAAELAQRHPDSQAARDA

IKLASQAARAVILAIMLAAENPNADIAKLCIKAASEAAEAASKAAELA

QRHPDSQAARDAIKLASQAAEAVERAIWLAAENPNADIAKKCIKAASE

AAEEASKAAEEAQRHPDSQKARDEIKEASQKAEEVKERCKS

In some embodiments of any of the aspects, a CAR polypeptide as described herein comprises a linker domain adjacent (e.g., N-terminal and/or C-terminal) to the reader domain. In some embodiments of any of the aspects, the reader domain linker comprises SEQ ID NO: 104 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 104. In some embodiments of any of the aspects, the reader domain linker is encoded by SEQ ID NO: 80, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 80 or a codon-optimized version thereof.

In several aspects, described herein are CAR polypeptides comprising a self-cleaving peptide. As used herein, the term "self-cleaving peptide" refers to a short amino acid sequence (e.g., approximately 18-22 aa-long peptides) that can catalyze its own cleavage. In some embodiments of any of the aspects, a multi-component CAR system as described herein (e.g., AND-gate CAR system, OFF-switch CAR system, reader CAR system) comprises at least two polypeptides that are physically linked to one another through a self-cleaving peptide domain. The self-cleaving peptide allows the nucleic acids of the first polypeptide and second polypeptide (and/or third polypeptide, etc.) to be present in the same vector, but after translation the self-cleaving peptide cleaves the translated polypeptide into the multiple separate polypeptides.

In some embodiments of any of the aspects, a CAR polypeptide as described herein (or a CAR polypeptide system collectively) comprises 1, 2, 3, 4, 5, or more self-cleaving peptides, e.g., in between each CAR polypeptide. In some embodiments of any of the aspects, the CAR polypeptide or system comprises one self-cleaving peptide, e.g., in between a first polypeptide and a second polypeptide of a CAR polypeptide system. In embodiments comprising multiple self-cleaving peptides, the multiple self-cleaving peptides can be different individual self-cleaving peptides or multiple copies of the same self-cleaving peptide, or a combination of the foregoing.

In some embodiments of any of the aspects, the self-cleaving peptide belongs to the 2A peptide family. Non-limiting examples of 2A peptides include P2A, E2A, F2A and T2A (see e.g., Table 18). F2A is derived from foot-and-mouth disease virus 18; E2A is derived from equine rhinitis A virus; P2A is derived from porcine teschovirus-1 2A; T2A is derived from those a asigna virus 2A. In some embodiments of any of the aspects, the N-terminal of the 2A peptide comprises the sequence "GSG" (Gly-Ser-Gly). In some embodiments of any of the aspects, the N-terminal of the 2A peptide does not comprise the sequence "GSG" (Gly-Ser-Gly).

TABLE 18

Exemplary Self-Cleaving Peptides

| SEQ ID NO: | Name | Sequence |
|---|---|---|
| 209 | T2A | (GSG) EGRGSLLTCGDVEENPGP |
| 210 | P2A | (GSG) ATNFSLLKQAGDVEENPGP |
| 211 | E2A | (GSG) QCTNYALLKLAGDVESNPGP |
| 212 | F2A | (GSG) VKQTLNFDLLKLAGDVESNPGP |

The 2A-peptide-mediated cleavage commences after protein translation. The cleavage is triggered by breaking of peptide bond between the Proline (P) and Glycine (G) in the C-terminal of the 2A peptide. The molecular mechanism of 2A-peptide-mediated cleavage involves ribosomal "skipping" of glycyl-prolyl peptide bond formation rather than true proteolytic cleavage. Different 2A peptides have different efficiencies of self-cleaving, with P2A being the most efficient and F2A the least efficient. Therefore, up to 50% of F2A-linked proteins can remain in the cell as a fusion protein.

In some embodiments of any of the aspects, the self-cleaving peptide of a CAR polypeptide system as described herein comprises SEQ ID NOs: 102, 123, 209-212, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 102, 123, 209-212, that maintains the same functions as one of SEQ ID NOs: 102, 123, 209-212 (e.g., self-cleavage). In some embodiments of any of the aspects, the self-cleaving peptide of a CAR polypeptide system as described herein comprises SEQ ID NOs: 102, 123, 209-212, or an amino acid sequence that is at least 95% identical to the sequence of one of SEQ ID NOs: 102, 123, 209-212, that maintains the same function.

In some embodiments of any of the aspects, the self-cleaving peptide of a CAR polypeptide system as described herein is encoded by a nucleic acid sequence comprising SEQ ID NOs: 78, 122 or a nucleic acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to one of SEQ ID NOs: 78 or 122 that maintains the same function or a codon-optimized version of one of SEQ ID NOs: 78 or 122. In some embodiments of any of the aspects, the self-cleaving peptide of a CAR polypeptide system as described herein is encoded by a nucleic acid sequence comprising SEQ ID NOs: 78, 122 or a nucleic acid sequence that is at least 95% identical to one of SEQ ID NOs: 78 or 122 that maintains the same function.

In some embodiments of any of the aspects, providing the multiple polypeptides of the CAR systems as described herein in a 1:1 (or 1:1:1, etc.) stoichiometric ratio is advantageous (e.g., this stoichiometric ratio results in optimal functionality). In embodiments where a 1:1 (or 1:1:1, etc.) ratio of the first and second (and third etc.) polypeptides of a CAR system is advantageous, then the first and second polypeptides can be provided in a single vector, flanking a self-cleaving peptide(s) as described herein. In embodiments where a 1:1 (or 1:1:1, etc.) ratio of the first and second (and third etc.) polypeptides of a CAR system is not advantageous (e.g., this stoichiometric ratio results in suboptimal functionality, and other ratios result in optimal functionality) then the first and second polypeptides can be provided in multiple separate vectors, e.g., at the desired stoichiometric ratios.

In some embodiments of any of the aspects, CAR polypeptides as described herein comprise a leading peptide, which can also be referred to as a leader sequence or a leader peptide or simply "leader". As used herein, the term "leading peptide" refers to an amino-terminal sequence comprising or consisting of a signal peptide and an optional secretion leader pro-peptide. The signal peptide typically consists of 13 to 36 rather hydrophobic amino acids. Signal peptides have a common structure: a short, positively charged amino-terminal region (n-region); a central hydrophobic region (h-region); and a more polar carboxy-terminal region (c-region) containing the site that is cleaved by the signal peptidase. On the ER luminal side, the signal peptide is cleaved off by a signal peptidase. After successful folding of the nascent polypeptide by ER resident chaperones and foldases, the protein is further directed to exit the ER. This process may be supported by the presence of an N-terminal pro-sequence.

In some embodiments of any of the aspects, a CAR polypeptide as described herein (or a CAR polypeptide system collectively) comprises 1, 2, 3, 4, 5, or more leading peptides, e.g., preceding each extracellular binding domain or each extracellular domain. In some embodiments of any of the aspects, the CAR polypeptide or system comprises one leading peptide. In some embodiments of any of the aspects, the CAR polypeptide or system comprises two leading peptides. In embodiments comprising multiple leading peptides, the multiple leading peptides can be different individual leading peptides or multiple copies of the same leading peptide, or a combination of the foregoing.

In some embodiments of any of the aspects, the leading peptide is a CD8a leading peptide. In some embodiments of any of the aspects, the leading peptide comprises SEQ ID NO: 40, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 40 that maintains the same functions as SEQ ID NO: 40. In some embodiments of any of the aspects, the leading peptide of a CAR polypeptide as described herein comprises SEQ ID NO: 40, or an amino acid sequence that is at least 95% identical to the sequence of SEQ ID NO: 40 that maintains the same function.

In some embodiments, the leading peptide of a CAR polypeptide as described herein is encoded by a nucleic acid sequence comprising SEQ ID NO: 7 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 7 that maintains the same function or a codon-optimized version of SEQ ID NO: 7. In some embodiments, the leading peptide of a CAR polypeptide as described herein is encoded by a nucleic acid sequence comprising SEQ ID NO: 7 or a sequence that is at least 95% identical to SEQ ID NO: 7 that maintains the same function.

In some embodiments of any of the aspects, a CAR polypeptide as described herein comprises an extracellular binding domain. In some embodiments of any of the aspects, a CAR polypeptide as described herein comprises at least 1, at least 2, at least 3, at least 4, at least 5, at least 6, at least 7, at least 8, at least 9, or at least 10 extracellular binding domains. In some embodiments of any of the aspects, the CAR polypeptide or system comprises one extracellular binding domain. In some embodiments of any of the aspects, the CAR polypeptide or system comprises two extracellular binding domains. In embodiments comprising multiple extracellular binding domains, the multiple extracellular binding domains can be different individual extracellular binding domains or multiple copies of the same extracellular binding domains, or a combination of the foregoing. In some embodiments of any of the aspects, the extracellular binding domain is an antibody, an antigen-binding fragment thereof, a F(ab) fragment, a F(ab') fragment, a single chain variable fragment (scFv), or a single-domain antibody (sdAb). In some embodiments of any of the aspects, the extracellular binding domain is monovalent, bivalent, or multivalent. In some embodiments of any of the aspects, the extracellular binding domain comprises a human, humanized, or chimeric antibody construct. Additionally, and as described herein, a recombinant humanized antibody can be further optimized to decrease potential immunogenicity, while maintaining functional activity, for therapy in humans. In this regard, functional activity means a polypeptide capable of displaying one or more known functional activities associated with a recombinant antibody or antibody reagent thereof as described herein. Such functional activities include, e.g. the ability to bind to a target.

Antibody reagents specific for the targets and/or markers described herein, e.g., tumor antigens are known in the art. For example, such reagents are readily commercially available. In some embodiments of any of the aspects, the extracellular binding domain can be an antibody reagent comprising one or more (e.g., one, two, three, four, five, or six) CDRs of any one of the antibodies described herein or known in the art. In some embodiments of any of the aspects, an antibody reagent specific for a target and/or maker described herein (e.g., that binds specifically to a tumor antigen as described herein) can be an antibody reagent comprising the six CDRs of any one of the antibodies described herein or known in the art. In some embodiments of any of the aspects, an antibody reagent specific for a target and/or maker described herein (e.g., that binds specifically to a tumor antigen as described herein) can be an antibody reagent comprising the three heavy chain CDRs of any one of the antibodies described herein or known in the art. In some embodiments of any of the aspects, an antibody reagent specific for a target and/or maker described herein (e.g., that binds specifically to a tumor antigen as described herein) can be an antibody reagent comprising the three light chain CDRs of any one of the antibodies described herein or known in the art. In some embodiments of any of the aspects, an antibody reagent specific for a target and/or maker described herein (e.g., that binds specifically to a tumor antigen as described herein) can be an antibody reagent comprising the VH and/or VL domains of any one of the antibodies described herein or known in the art. In some embodiments of any of the aspects, an antibody reagent specific for a target and/or maker described herein (e.g., that binds specifically to a tumor antigen as described herein) can be an antibody reagent comprising the VH and VL domains of any one of the antibodies described herein or known in the art. Such antibody reagents are specifically contemplated for use in the methods and/or compositions described herein.

As used herein, "antibody variable domain" refers to the portions of the light and heavy chains of antibody molecules that include amino acid sequences of Complementarity Determining Regions (CDRs; i.e., CDR1, CDR2, and CDR3), and Framework Regions (FRs). VH refers to the variable domain of the heavy chain. VL refers to the variable domain of the light chain. For the methods and compositions described herein, the amino acid positions assigned to CDRs and FRs may be defined according to Rabat (Sequences of Proteins of Immunological Interest (National Institutes of Health, Bethesda, Md., 1987 and 1991)). Amino acid numbering of antibodies or antigen binding fragments is also according to that of Rabat.

The terms "antigen-binding fragment" or "antigen-binding domain", which are used interchangeably herein are used to refer to one or more fragments of a full length antibody that retain the ability to specifically bind to a target of interest. Examples of binding fragments encompassed within the term "antigen-binding fragment" of a full length antibody include (i) a Fab fragment, a monovalent fragment consisting of the VL, VH, CL and CH1 domains; (ii) a F(ab')2 fragment, a bivalent fragment including two Fab fragments linked by a disulfide bridge at the hinge region; (iii) an Fd fragment consisting of the VH and CH1 domains; (iv) an Fv fragment consisting of the VL and VH domains of a single arm of an antibody, (v) a dAb fragment (Ward et al., (1989) Nature 341:544-546; which is incorporated by reference herein in its entirety), which consists of a VH or VL domain; and (vi) an isolated complementarity determining region (CDR) that retains specific antigen-binding functionality. The light chain and heavy chain-derived sequences can be provided in N to C terminal order respectively, or in the opposite order.

As used herein, the term "linker" refers to a chemical or peptide structure that covalently joins two polypeptide moieties. For example, a VH domain and a VL domain of an antibody can be joined by a peptide linker to form a VH/VL single chain antigen binding domain (e.g., as an scFv). Lengths of linkers can be varied to modify the ability of linked domains to form, e.g., intramolecular or intermolecular dimers. For example, a diabody includes a short linker peptide between VH and VL domains, usually 5 amino acids, that will not permit the VH and VL domains to pair to form an antigen-binding domain; expression of two different VH-VL constructs with this short linker arrangement in a cell permits the VH domain of a first VH-VL polypeptide chain to dimerize with the VL domain of the second VH-VL polypeptide chain, and the corresponding VL domain of the first VH-VL polypeptide chain to dimerize with the VH domain of the second VH-VL polypeptide chain, thereby generating a bispecific construct. In contrast, when the VH and VL domains are separated by a longer peptide linker, most often 15-20 amino acids, the VH domain and the VL domain on the same polypeptide chain can dimerize to form an scFv. Non-limiting examples of such linkers are described herein, including SEQ ID: 23 and 56.

In some embodiments of any of the aspects, the extracellular binding domain comprises a scFv. In some embodiments of any of the aspects, the extracellular binding domain comprises a scFv that specifically binds to a tumor antigen. In some embodiments of any of the aspects, the extracellular binding domain of a CAR polypeptide as described herein specifically binds to any tumor antigen, including those described herein. In some embodiments of any of the aspects, the extracellular binding domain comprises any known antibody, an antigen-binding fragment thereof, a F(ab) fragment, a F(ab') fragment, a single chain variable fragment (scFv), or a single-domain antibody (sdAb) that binds to a tumor antigen or epitope as described herein.

Non-limiting examples of tumor antigens that can be targeted include EphA2, HER2, AXL, GD2, Glypican-3, 5T4, 8H9, αβ6 integrin, BCMA, B7-H3, B7-H6, CAIX, CA9, CD19, CD20, CD22, kappa light chain, CD30, CD33, CD38, CD44, CD44v6, CD44v7/8, CD70, CD123, CD138, CD171, CEA, CSPG4, EGFR, EGFRvIII, EGP2, EGP40, EPCAM, ERBB3, ERBB4, ErbB3/4, FAP, FAR, FBP, fetal AchR, Folate Receptor a, GD2, GD3, HLA-AI MAGE Al, HLA-A2, IL1 1Ra, IL13Ra2, KDR, Lambda, Lewis-Y, MCSP, Mesothelin, Mucl, Mucl6, NCAM, NKG2D ligands, NY-ESO-1, PRAME, PSCA, PSC1, PSMA, ROR1, SURVIVIN, TAG72, TEM1, TEM8, VEGRR2, carcinoembryonic antigen, HMW-MAA, and VEGF receptors. Other exemplary antigens that can be targeted are antigens that are present with in the extracellular matrix of tumors, such as oncofetal variants of fibronectin, tenascin, or necrotic regions of tumors.

Additional tumor-selective molecules that can be targeted include any membrane protein or biomarker that is expressed or overexpressed in tumor cells including, but not limited to, integrins (e.g., integrin αvβ3, α5β1), EGF Receptor Family (e.g., EGFR2, Erbb2/HER2/neu, Erbb3, Erbb4), proteoglycans (e.g., heparan sulfate proteoglycans), disialogangliosides (e.g., GD2, GD3), B7-H3 (aka CD276), cancer antigen 125 (CA-125), epithelial cell adhesion molecule (EpCAM), vascular endothelial growth factor receptors 1 and 2 (VEGFR-1, VEGFR-2), CD52, carcinoembryonic antigen (CEA), tumor associated glycoproteins (e.g., TAG-72), cluster of differentiation 19 (CD19), CD20, CD22, CD30, CD33, CD40, CD44, CD74, CD 152, mucin 1 (MUC1), tumor necrosis factor receptors (e.g., TRAIL-R2), insulin-like growth factor receptors, folate receptor a, transmembrane glycoprotein NMB (GPNMB), C-C chemokine receptors (e.g., CCR4), prostate specific membrane antigen (PSMA), recepteur d'origine nantais (RON) receptor, cytotoxic T-lymphocyte antigen 4 (CTLA4), and other tumor specific receptors or antigens.

Non-limiting examples of tumor antigens include the following: Differentiation antigens such as MART-1/ MelanA (MART-I), gp100 (Pmel 17), tyrosinase, TRP-1, TRP-2 and tumor-specific multilineage antigens such as MAGE-1, MAGE-3, BAGE, GAGE-1, GAGE-2, p15; overexpressed embryonic antigens such as CEA; overexpressed oncogenes and mutated tumor-suppressor genes such as p53, Ras, HER-2/neu; unique tumor antigens resulting from chromosomal translocations; such as BCR-ABL, E2A-PRL, H4-RET, IGH-IGK, MYL-RAR; and viral antigens, such as the Epstein Barr virus antigens EBVA and the human papillomavirus (HPV) antigens E6 and E7. Other large, protein-based antigens include TSP-180, MAGE-4, MAGE-5, MAGE-6, RAGE, NY-ESO, p185erbB2, p180erbB-3, c-met, nm-23H1, PSA, TAG-72, CA 19-9, CA 72-4, CAM 17.1, NuMa, K-ras, beta-Catenin, CDK4, Mum-1, p 15, p 16, 43-9F, 5T4, 791Tgp72, alpha-fetoprotein, beta-HCG, BCA225, BTAA, CA 125, CA 15-3\CA 27.29\BCAA, CA 195, CA 242, CA-50, CAM43, CD68\P1, CO-029, FGF-5, G250, Ga733\EpCAM, HTgp-175, M344, MA-50, MG7-Ag, MOV18, NB/70K, NY-CO-1, RCAS1, SDCCAG16, TA-90\Mac-2 binding protein\cyclophilin C-associated protein, TAAL6, TAG72, TLP, and TPS.

In some embodiments of any of the aspects, the tumor antigen is a tumor antigen described in International Application PCT/US2015/020606 or US Patent Applications US20170209492 or US20170335281, the contents of each of which are herein incorporated by reference in their entireties. In some embodiments, the tumor antigen is chosen from one or more of: CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRvIII); ganglioside G2 (GD2); ganglioside GD3 (aNeu5Ac(2-8)aNeu5Ac(2-3)bD-Galp(1-4)bDG1cp(1-1)Cer); TNF receptor family member B cell maturation (BCMA); Tn antigen ((Tn Ag) or (GalNAca-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EPCAM); B7H3 (CD276); KIT (CD 117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp 100); oncogene fusion protein consisting of breakpoint cluster region (BCR) and Abelson murine leukemia viral oncogene homolog 1 (Abl) (bcr-ab1); tyrosinase; ephrin type-A receptor 2 (EphA2); Fucosyl GM1; sialyl Lewis adhesion molecule (sLe); ganglioside GM3 (aNeu5Ac(2-3)bDGalp(1-4) bDG1cp(1-1)Cer); transglutaminase 5 (TGS5); high molecular weight-melanoma-associated antigen (HMW-MAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein-coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC 1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCTA-1 or Galectin 8), melanoma antigen recognized by T cells 1 (MelanA or MART1); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B 1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B1 (CYP1B1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAXS); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU 1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1). In some embodiments, the tumor antigen is GFRa4 (see e.g., Spinasanta, "The Endocrine Society's 97th Annual Meeting & Expo: Targeted Therapies in Medullary Thyroid Cancer" Mar. 13, 2015).

In some embodiments of any of the aspects, the extracellular binding domain comprises an anti-Her2 antibody. HER2 (human epidermal growth factor receptor 2) is a gene that plays a role in the development of breast cancer. Cancers that can be HER2 positive include breast, bladder, pancreatic, ovarian, and stomach cancers. Non-limiting examples of anti-Her2 antibodies include G98A, C6.5, ML39, H3B1 (e.g., SEQ ID NOs: 8, 41), scFv800E6, and trastuzumab. See e.g., Rudnick et al., Cancer Res. 2011 Mar. 15, 71(6): 2250-2259; Sommaruga et al. Appl Microbiol Biotechnol. 2011 August, 91(3):613-21; US Patents U.S.

Pat. Nos. 5,977,322, 8,580,263, 8,703,427, 8,927,694, U.S. Ser. No. 10/188,742, U.S. Ser. No. 10/239,951, the contents of each of which are incorporated herein by reference in their entireties.

In some embodiments of any of the aspects, the extracellular binding domain comprises an anti-Axl antibody. AXL overexpression has been demonstrated in various cancer types, e.g. breast (Meric et al., Clin. Cancer Res. 8: 361-367, 2002; Berclaz et al., Ann. Oncol. 12: 819-824, 2001), colon (Chen et al., Int. J. Cancer 83: 579-584, 1999; Craven et al., Int. J. Cancer 60: 791-797, 1995), prostate (Jacob et al., Cancer Detect. Prey. 23: 325-332, 1999), lung (Wimmel et al., Eur J Cancer 37: 2264-2274, 2001), gastric (Wu et al., Anticancer Res 22: 1071-1078, 2002), ovarian (Sun et al., Oncology 66: 450-457, 2004), endometrial (Sun et al., Ann. Oncol. 14: 898-906, 2003), renal (Chung et al., DNA Cell Biol. 22: 533-540, 2003), hepatocellular (Tsou et al., Genomics 50:331-340, 1998), thyroid (Ito et al., Thyroid 12:971-975, 2002; Ito et al., Thyroid 9: 563-567, 1999), and esophageal carcinoma (Nemoto et al., 1997), furthermore in CML (Janssen et al., A novel putative tyrosine kinase receptor with oncogenic potential. Oncogene, 6: 2113-2120, 1991; Braunger et al., Oncogene 14:2619-2631 1997; O'Bryan et al., Mol Cell Biol 11:5016-5031, 1991), AML (Rochlitz et al., Leukemia 13: 1352-1358, 1999), osteosarcoma (Nakano et al., J. Biol. Chem. 270:5702-5705, 2003) melanoma (van Ginkel et al., Cancer Res 64:128-134, 2004) and in head and neck squamous cell carcinoma (Green et al., Br J. Cancer. 2006 94:1446-5, 2006). Moreover, AXL has been identified as a metastasis-associated gene that is upregulated in aggressive breast cancer cell lines compared to non-invasive cells. Non-limiting examples of anti-Axl antibodies include 11B7, 11D5, 10D12, and h #11B7-T18 (e.g., SEQ ID NOs: 22-24, 55-57). See e.g., International Patent Application WO2010130751 or US Patent U.S. Pat. No. 8,841,424, the contents of each of which are incorporated herein by reference in their entireties.

In some embodiments of any of the aspects, the extracellular binding domain comprises an anti-CD 19 antibody. Since CD19 is a marker of B cells, the protein has been used to diagnose cancers that arise from this type of cell—notably B cell lymphomas, acute lymphoblastic leukemia (ALL), and chronic lymphocytic leukemia (CLL). The majority of B cell malignancies express normal to high levels of CD 19. Non-limiting examples of anti-CD19 antibodies include A3B1, FMC63, FMC63-28Z, SEQ ID NO: 94; see e.g., U.S. patent Ser. No. 10/221,245, U.S. Pat. No. 8,906,682, Ser. No. 10/421,810, the contents of each of which are incorporated herein by reference in their entireties.

Depending on the desired antigen to be targeted, the CAR polypeptide described herein can be engineered to include the appropriate antigen bind moiety that is specific to the desired antigen target. For example, if CD 19 is the desired antigen that is to be targeted, an antibody for CD 19 can be used as the antigen bind moiety for incorporation into a CAR polypeptide as described herein.

In some embodiments of any of the aspects, the extracellular binding domain of a CAR polypeptide as described herein comprises SEQ ID NOs: 41, 55-57, 94, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 41, 55-57, 94, that maintains the same functions as one of SEQ ID NOs: 41, 55-57, 94 (e.g., tumor antigen binding). In some embodiments of any of the aspects, the extracellular binding domain of a CAR polypeptide as described herein comprises SEQ ID NOs: 41, 55-57, 94, or an amino acid sequence that is at least 95% identical to the sequence of one of SEQ ID NOs: 41, 55-57, or 94, that maintains the same function.

In some embodiments of any of the aspects, the extracellular binding domain of a CAR polypeptide as described herein is encoded by a nucleic acid sequence comprising SEQ ID NOs: 8, 22-24, 70 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to one of SEQ ID NOs: 8, 22-24, or 70 that maintains the same function or a codon-optimized version of one of SEQ ID NOs: 8, 22-24, or 70. In some embodiments of any of the aspects, the extracellular binding domain of a CAR polypeptide as described herein is encoded by a nucleic acid sequence comprising SEQ ID NOs: 8, 22-24, 70 or a sequence that is at least 95% identical to one of SEQ ID NOs: 8, 22-24, or 70 that maintains the same function.

In some embodiments of any of the aspects, the extracellular binding domain can target antigens involved in diseases other than cancer (e.g., alloimmunity, autoimmunity, infectious disease, etc.). In some embodiments of any of the aspects, the extracellular binding domain can target its antigen using a biotinylated antigen-specific molecules, e.g., instead of a scFv.

In some embodiments of any of the aspects, a CAR polypeptide as described herein comprises a spacer domain. In some embodiments of any of the aspects, the spacer domain is located between the extracellular binding domain and the transmembrane domain. In some embodiments of any of the aspects, the spacer domain is C terminal of the extracellular binding domain and N terminal of the transmembrane domain. In some embodiments of any of the aspects, the spacer domain comprises a hinge domain. In some embodiments of any of the aspects, a CAR polypeptide as described herein (or a CAR polypeptide system collectively) comprises 1, 2, 3, 4, 5, or more hinge domains, e.g., C terminal of each extracellular binding domain. In some embodiments of any of the aspects, the CAR polypeptide or system comprises one hinge domain. In embodiments comprising multiple hinge domains, the multiple hinge domains can be different individual hinge domains or multiple copies of the same hinge domain, or a combination of the foregoing.

In some embodiments of any of the aspects, the hinge domain comprises an immunoglobulin G (IgG)-based hinge or a derivative of CD8a or CD28 extracellular domains. Incorporation of a hinge domain has been shown to improve the expansion of chimeric antigen receptor T cells and to increase the antitumor efficacy of CAR T cells (see e.g., Qin et al., Journal of Hematology & Oncology volume 10, Article number: 68 (2017); Stoiber et al., Cells. 2019 May; 8(5): 472). Hinge domains can be derived from IgG subclasses (such as IgG1 and IgG4), IgD and CD8 domains, of which IgG1 has been most extensively used. A hinge domain preferably provides the following four aspects: (1) reduced binding affinity to the Fcγ receptor, thereby eliminating off-target activation; (2) enhanced flexibility for the extracellular binding domain (e.g., scFv), thereby relieving the spatial constraints between tumor antigens and CARs, in turn promoting synapse formation between the CAR T cells and target cells; for example, to overcome steric hindrance in MUC1-specific CAR, a flexible and elongated hinge of the IgD isotype can be inserted; (3) reduced distance between an extracellular binding domain (e.g., scFv) and the target antigen or epitope, for example, anti-CD22 CAR needs a hinge domain to exert optimal cytotoxicity; and (4) facilitated detection of CAR expression using anti-Fc reagents. In some embodiments of any of the aspects, the hinge domain promotes CAR dimerization.

In some embodiments of any of the aspects, the hinge domain comprises a CD8a hinge domain. In some embodiments of any of the aspects, the hinge domain of a CAR polypeptide as described herein comprises SEQ ID NO: 43, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 43, that maintains the same functions as SEQ ID NO: 43 (e.g., displaying the extracellular binding region). In some embodiments of any of the aspects, the hinge domain of a CAR polypeptide as described herein comprises SEQ ID NO: 43, or an amino acid sequence that is at least 95% identical to the sequence of SEQ ID NO: 43, that maintains the same function.

In some embodiments of any of the aspects, the hinge domain of a CAR polypeptide as described herein is encoded by a nucleic acid sequence comprising SEQ ID NO: 10 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 10 that maintains the same function or a codon-optimized version of SEQ ID NO: 10. In some embodiments of any of the aspects, the hinge domain of a CAR polypeptide as described herein is encoded by a nucleic acid sequence comprising SEQ ID NO: 10 or a sequence that is at least 95% identical to SEQ ID NO: 10 that maintains the same function.

In several aspects, described herein are CAR polypeptides comprising an extracellular domain (e.g., OFF-switch CAR polypeptides, and reader CAR polypeptides). As used herein, the term "extracellular domain" refers to a portion of a polypeptide that is external to the cell membrane. The term "ectodomain" can be used interchangeably with "extracellular domain." In one embodiment, a polypeptide comprising an extracellular domain also comprises a transmembrane domain as described herein. In some embodiments of any of the aspects, a polypeptide comprises an extracellular domain that is not an extracellular binding domain. In some embodiments of any of the aspects, a CAR polypeptide as described herein (or a CAR polypeptide system collectively) comprises 1, 2, 3, 4, 5, or more extracellular domains. In some embodiments of any of the aspects, the CAR polypeptide or system comprises one extracellular domain. In embodiments comprising multiple extracellular domains, the multiple extracellular domains can be different individual extracellular domains or multiple copies of the same extracellular domain, or a combination of the foregoing.

In some embodiments of any of the aspects, the CAR polypeptide can comprise an extracellular domain selected from the extracellular domains of: TCRC; FcRy; FcRp; CD3zeta; CD3y; CD3S; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-Ll); CD278 (ICOS); DAP10; LAT; KD2C SLP76; TRIM; ZAP70; and 41BB.

In some embodiments of any of the aspects, the extracellular domain can comprise the DNAX-activating protein 10 (DAP10) ectodomain. The DAP10 ectodomain mediates homo-dimerization; see e.g., Wu J, Song Y, Bakker A B, Bauer S, Spies T, Lanier L L, Phillips J H Science. 1999 Jul. 30; 285(5428):730-2. Therefore, a polypeptide comprising a DAP10 ectodomain can recruit a second polypeptide comprising a DAP10 ectodomain, leading to increased numbers and activities of these polypeptides. In some embodiments of any of the aspects, the extracellular domain comprises a homodimerization domain.

In some embodiments of any of the aspects, the extracellular domain of a CAR polypeptide as described herein comprises SEQ ID NO: 47, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 47, that maintains the same functions as SEQ ID NO: 47 (e.g., homo-dimerization). In some embodiments of any of the aspects, the extracellular domain of a CAR polypeptide as described herein comprises SEQ ID NO: 47, or an amino acid sequence that is at least 95% identical to the sequence of SEQ ID NO: 47, that maintains the same function.

In some embodiments, the extracellular domain of a CAR polypeptide as described herein is encoded by a nucleic acid sequence comprising SEQ ID NO: 72 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 72 that maintains the same function or a codon-optimized version of SEQ ID NO: 72. In some embodiments, the extracellular domain of a CAR polypeptide as described herein is encoded by a nucleic acid sequence comprising SEQ ID NO: 72 or a sequence that is at least 95% identical to SEQ ID NO: 72 that maintains the same function.

In several aspects, described herein are CAR polypeptides comprising a transmembrane domain. With respect to the transmembrane domain, the CAR can be designed to comprise a transmembrane domain that is fused to the extracellular domain or extracellular binding domain of the CAR. In some embodiments of any of the aspects, the CAR polypeptide (or the CAR polypeptide system collectively) comprises 1, 2, 3, 4, 5, or more transmembrane domains. In some embodiments of any of the aspects, each CAR polypeptide comprises one transmembrane domain. In embodiments comprising multiple transmembrane domains, the multiple transmembrane domains can be different individual transmembrane domains or multiple copies of the same transmembrane domain, or a combination of the foregoing.

In one embodiment, the transmembrane domain that naturally is associated with one of the domains in the CAR is used. In some instances, the transmembrane domain can be selected or modified by amino acid substitution to avoid binding of such domains to the transmembrane domains of the same or different surface membrane proteins to minimize interactions with other members of the receptor complex.

In some embodiments of any of the aspects, the transmembrane domain can be derived either from a natural or from a synthetic source. Where the source is natural, the domain can be derived from any membrane-bound or transmembrane protein. Transmembrane regions of particular use for the CAR polypeptide described herein (i.e. comprise at least the transmembrane region(s) of) the alpha, beta or zeta chain of the T-cell receptor, CD28, CD23zeta, CD28, 4-1BB, CD3 epsilon, CD45, CD4, CD5, CD8, CD9, CD16, CD22, CD33, CD37, CD64, CD80, CD86, CD134, CD137, CD154. Alternatively, the transmembrane domain can be synthetic, in which case it will comprise predominantly hydrophobic residues such as leucine and valine. Preferably a triplet of phenylalanine, tryptophan and valine will be found at each end of a synthetic transmembrane domain. Optionally, a short oligo- or polypeptide linker, preferably between 2 and 10 amino acids in length may form the linkage between the transmembrane domain and the cytoplasmic signaling domain of the CAR. A glycine-serine doublet provides a particularly suitable linker. In some embodiments of any of the aspects, the transmembrane domain comprises the transmembrane domain of CD28. In some embodiments of any of the aspects, the transmembrane domain comprises the transmembrane domain of CD8.

In some embodiments of any of the aspects, the transmembrane domain of a CAR polypeptide as described herein comprises SEQ ID NOs: 44, 97, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 44 or 97, that maintains the same functions as SEQ ID NOs: 44 or 97 (e.g., localizes to the cell membrane). In some embodiments of any of the aspects, the transmembrane domain of a CAR polypeptide as described herein comprises SEQ ID NOs: 44, 97, or an amino acid sequence that is at least 95% identical to the sequence of SEQ ID NO: 44 or 97 that maintains the same function.

In some embodiments of any of the aspects, the transmembrane domain of a CAR polypeptide as described herein is encoded by a nucleic acid sequence comprising SEQ ID NOs: 11, 73, 124 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to one of SEQ ID NOs: 11, 73, or 124 that maintains the same function or a codon-optimized version of one of SEQ ID NOs: 11, 73, or 124. In some embodiments of any of the aspects, the transmembrane domain of a CAR polypeptide as described herein is encoded by a nucleic acid sequence comprising SEQ ID NOs: 11, 73, 124 or a sequence that is at least 95% identical to one of SEQ ID NOs: 11, 73, or 124 that maintains the same function.

```
SEQ ID NO: 124, CD8 transmembrane domain, 63 nt
(bold double underlined text shows T42C silent
mutation from SEQ ID NO: 73; the mutation has no
effect on the amino acid sequence, thus SEQ ID
NOs: 73 and 124 can be used interchangeably).

ATATACATCTGGGCTCCTCTGGCTGGCACTTGCGGAGTGCTCCTGCTG

AGTCTGGTTATTACC
```

In some embodiments of any of the aspects, a CAR polypeptide as described herein does not comprise an extracellular domain, an extracellular binding domain, and/or a transmembrane domain. Accordingly, CAR polypeptides as described herein can be cytosolic proteins, as opposed to transmembrane proteins, especially when the CAR polypeptide does not comprise an extracellular binding domain.

In several aspects, described herein are CAR polypeptides comprising at least one intracellular signaling domain. The cytoplasmic domain or otherwise the intracellular signaling domain of the CAR polypeptides described herein is responsible for activation of at least one of the normal effector functions of the immune cell in which the CAR has been placed in. The term "effector function" refers to a specialized function of a cell. Effector function of a T cell, for example, may be cytolytic activity or helper activity including the secretion of cytokines. Thus the term "intracellular signaling domain" refers to the portion of a protein which transduces the effector function signal (e.g., from the extracellular biding domain specifically binding its cognate antigen) and directs the cell to perform a specialized function. While usually the entire intracellular signaling domain can be employed, in many cases it is not necessary to use the entire chain. To the extent that a truncated portion of the intracellular signaling domain is used, such truncated portion may be used in place of the intact chain as long as it transduces the effector function signal. The term intracellular signaling domain is thus meant to include any truncated portion of the intracellular signaling domain sufficient to transduce the effector function signal.

In some embodiments of any of the aspects, the CAR polypeptide (or the CAR polypeptide system collectively) comprises 1, 2, 3, 4, 5, or more intracellular signaling domains. In some embodiments of any of the aspects, the CAR polypeptide or system comprises three intracellular signaling domains. In embodiments comprising multiple intracellular signaling domains, the multiple intracellular signaling domains can be different individual intracellular signaling domains or multiple copies of the same intracellular signaling domain, or a combination of the foregoing.

Non-limiting examples of intracellular signaling domains for use in the CAR polypeptides described herein include the cytoplasmic sequences of the T cell receptor (TCR) and co-receptors that act in concert to initiate signal transduction following antigen receptor engagement, as well as any derivative or variant of these sequences and any synthetic sequence that has the same functional capability.

Signals generated through the TCR alone are insufficient for full activation of the T cell and that a secondary or co-stimulatory signal is also required. Thus, T cell activation can be said to be mediated by two distinct classes of cytoplasmic signaling sequence: those that initiate antigen-dependent primary activation through the TCR (primary cytoplasmic signaling sequences) and those that act in an antigen-independent manner to provide a secondary or co-stimulatory signal (secondary cytoplasmic signaling sequences).

Primary cytoplasmic signaling sequences regulate primary activation of the TCR complex either in a stimulatory way, or in an inhibitory way. Primary cytoplasmic signaling sequences that act in a stimulatory manner may contain signaling motifs which are known as immunoreceptor tyrosine-based activation motifs or ITAMs.

Examples of ITAM containing primary cytoplasmic signaling sequences that are of particular use in the CAR polypeptides described herein include those derived from TCR zeta (also referred to as the zeta-chain, CD3zeta, or CD247), FcR gamma, FcR beta, CD3 gamma, CD3 delta, CD3 epsilon, CD5, CD22, CD79a, CD79b, and CD66d. A cytoplasmic signaling molecule in the CAR polypeptide can comprise a cytoplasmic signaling sequence derived from CD3 zeta.

In one embodiment, the cytoplasmic domain of the CAR can be designed to comprise the CD3-zeta signaling domain by itself or combined with any other desired cytoplasmic domain(s) useful in the context of the CAR polypeptides described herein. For example, the cytoplasmic domain of the CAR can comprise a CD3 zeta chain portion and a costimulatory signaling region. The costimulatory signaling region refers to a portion of the CAR comprising the intracellular domain of a costimulatory molecule. A costimulatory molecule is a cell surface molecule other than an antigen receptor or their ligands that is required for an efficient response of lymphocytes to an antigen. Examples of such molecules include CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, and a ligand that specifically binds with CD83, and the like. Thus, while the CAR polypeptides described herein are exemplified primarily with 4-1BB and CD28 as the co-stimulatory signaling elements, other costimulatory elements are within the scope of the invention.

The cytoplasmic signaling sequences within the cytoplasmic signaling portion of the CAR polypeptides described herein may be linked to each other in a random or specified order. Optionally, a short oligo- or polypeptide linker, preferably between 2 and 10 amino acids in length may form the linkage. A glycine-serine doublet provides a particularly suitable linker.

In one embodiment, the cytoplasmic domain is designed to comprise the signaling domain of CD3-zeta and the signaling domain of CD28. In another embodiment, the cytoplasmic domain is designed to comprise the signaling domain of CD3-zeta and the signaling domain of 4-1BB. In yet another embodiment, the cytoplasmic domain is designed to comprise the signaling domain of CD3-zeta and the signaling domain of CD28 and 4-1BB.

In one embodiment of any aspect, the intracellular signaling domain is a signaling domain from a protein selected from the group consisting of: TCRC; FcRy; FcRp; CD3zeta; CD3y; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-L1); CD278 (ICOS); DAP10; LAT; KD2C SLP76; TRIM; ZAP70; and 41BB.

In some embodiments of any of the aspects, the intracellular signaling domain of a CAR polypeptide as described herein comprises SEQ ID NOs: 52, 53, 54, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 52-54, that maintains the same functions as one of SEQ ID NOs: 52-54 (e.g., intracellular signaling upon activation of the CAR polypeptide by binding its cognate antigen). In some embodiments of any of the aspects, the intracellular signaling domain of a CAR polypeptide as described herein comprises SEQ ID NOs: 52, 53, 54, or an amino acid sequence that is at least 95% identical to the sequence of one of SEQ ID NOs: 52-54 that maintains the same function.

In some embodiments of any of the aspects, the intracellular signaling domain of a CAR polypeptide as described herein is encoded by a nucleic acid sequence comprising SEQ ID NOs: 19, 20, 21 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to one of SEQ ID NOs: 19-21 that maintains the same function or a codon-optimized version of one of SEQ ID NOs: 19-21. In some embodiments of any of the aspects, the intracellular signaling domain of a CAR polypeptide as described herein is encoded by a nucleic acid sequence comprising SEQ ID NOs: 19, 20, 21 or a sequence that is at least 95% identical to one of SEQ ID NOs: 19-21 that maintains the same function.

In some embodiments of any of the aspects, a CAR polypeptide as described herein comprises the intracellular signaling domain of CD28, which comprises SEQ ID NO: 52 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 52, that maintains the same function. In some embodiments of any of the aspects, a CAR polypeptide as described herein comprises the intracellular signaling domain of CD28, which comprises SEQ ID NO: 52 or an amino acid sequence that is at least 95% identical to the sequence of SEQ ID NO: 52, that maintains the same function.

In some embodiments of any of the aspects, a CAR polypeptide as described herein comprises the intracellular signaling domain of CD28, which is encoded by a nucleic acid sequence comprising SEQ ID NO: 19 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 19 that maintains the same function or a codon-optimized version of SEQ ID NO: 19. In some embodiments of any of the aspects, a CAR polypeptide as described herein comprises the intracellular signaling domain of CD28, which is encoded by a nucleic acid sequence comprising SEQ ID NO: 19 or a sequence that is at least 95% identical to SEQ ID NO: 19 that maintains the same function.

In some embodiments of any of the aspects, a CAR polypeptide as described herein comprises the intracellular signaling domain of 4-1BB, which comprises SEQ ID NO: 53 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 53, that maintains the same function. In some embodiments of any of the aspects, a CAR polypeptide as described herein comprises the intracellular signaling domain of 4-1BB, which comprises SEQ ID NO: 53 or an amino acid sequence that is at least 95% identical to the sequence of SEQ ID NO: 53, that maintains the same function.

In some embodiments of any of the aspects, a CAR polypeptide as described herein comprises the intracellular signaling domain of 4-1BB, which is encoded by a nucleic acid sequence comprising SEQ ID NO: 20 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 20 that maintains the same function or a codon-optimized version of SEQ ID NO: 20. In some embodiments of any of the aspects, a CAR polypeptide as described herein comprises the intracellular signaling domain of 4-1BB, which is encoded by a nucleic acid sequence comprising SEQ ID NO: 20 or a sequence that is at least 95% identical to SEQ ID NO: 20 that maintains the same function.

In some embodiments of any of the aspects, a CAR polypeptide as described herein comprises the intracellular signaling domain of CD3zeta, which comprises SEQ ID NO: 54 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 54, that maintains the same function. In some embodiments of any of the aspects, a CAR polypeptide as described herein comprises the intracellular signaling domain of CD3zeta, which comprises SEQ ID NO: 54 or an amino acid sequence that is at least 95% identical to the sequence of SEQ ID NO: 54, that maintains the same function.

In some embodiments of any of the aspects, a CAR polypeptide as described herein comprises the intracellular signaling domain of CD3zeta, which is encoded by a nucleic acid sequence comprising SEQ ID NO: 21 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 21 that maintains the same function or a codon-optimized version of SEQ ID NO: 21. In some embodiments of any of the aspects, a CAR polypeptide as described herein comprises the intracellular signaling domain of CD3zeta, which is encoded by a nucleic acid sequence comprising SEQ ID NO: 21 or a sequence that is at least 95% identical to SEQ ID NO: 21 that maintains the same function.

In several aspects, described herein are CAR polypeptides comprising at least one detectable marker. As used herein, the term "detectable marker" refers to a moiety that, when attached to the CAR polypeptide, confers detectability upon that polypeptide or another molecule to which the polypeptide binds. In some embodiments of any of the aspects, the CAR polypeptide (or the CAR polypeptide system collectively) comprises 1, 2, 3, 4, 5, or more detectable markers. In some embodiments of any of the aspects, the CAR polypeptide or system comprises one detectable marker. In embodiments comprising multiple detectable markers, the multiple detectable markers can be different individual detectable markers or multiple copies of the same detectable markers, or a combination of the foregoing.

In some embodiments of any of the aspects, fluorescent moieties can be used as detectable markers, but detectable markers also include, for example, isotopes, fluorescent proteins and peptides, enzymes, components of a specific binding pair, chromophores, affinity tags as defined herein, antibodies, colloidal metals (i.e. gold) and quantum dots. Detectable markers can be either directly or indirectly detectable. Directly detectable markers do not require additional reagents or substrates in order to generate detectable signal. Examples include isotopes and fluorophores. Indirectly detectable markers require the presence or action of one or more co-factors or substrates. Examples include enzymes such as β-galactosidase which is detectable by generation of colored reaction products upon cleavage of substrates such as the chromogen X-gal (5-bromo-4-chloro-3-indoyl-β-D-galactopyranoside), horseradish peroxidase which is detectable by generation of a colored reaction product in the presence of the substrate diaminobenzidine and alkaline phosphatase which is detectable by generation of colored reaction product in the presence of nitroblue tetrazolium and 5-bromo-4-chloro-3-indolyl phosphate, and affinity tags. Non-limiting examples of affinity tags include Strep-tags, chitin binding proteins (CBP), maltose binding proteins (MBP), glutathione-S-transferase (GST), FLAG-tags, HA-tags, Myc-tags, poly(His)-tags as well as derivatives thereof. In some embodiments of any of the aspects, the detectable marker is selected from GFP, V5, HA1, Myc, VSV-G, HSV, FLAG, HIS, mCherry, AU1, and biotin.

In some embodiments of any of the aspects, the detectable marker of a CAR polypeptide as described herein comprises SEQ ID NOs: 42, 47, 51, 58, or 100, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 42, 47, 51, 58, or 100, that maintains the same functions as one of SEQ ID NOs: 42, 47, 51, 58, or 100 (e.g., detection of the CAR polypeptide or cleaved fragments of the CAR polypeptide). In some embodiments of any of the aspects, the detectable marker of a CAR polypeptide as described herein comprises SEQ ID NOs: 42, 47, 51, 58, or 100, or an amino acid sequence that is at least 95% identical to the sequence of one of SEQ ID NOs: 42, 47, 51, 58, or 100, that maintains the same function.

In some embodiments of any of the aspects, the detectable marker of a CAR polypeptide as described herein is encoded by a nucleic acid sequence comprising SEQ ID NOs: 9, 14, 18, 25, 76, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to one of SEQ ID NOs: 9, 14, 18, 25, 76 that maintains the same function or a codon-optimized version of one of SEQ ID NOs: 9, 14, 18, 25, 76. In some embodiments of any of the aspects, the detectable marker of a CAR polypeptide as described herein is encoded by a nucleic acid sequence comprising SEQ ID NOs: 9, 14, 18, 25, 76, or a sequence that is at least 95% identical to one of SEQ ID NOs: 9, 14, 18, 25, 76 that maintains the same function.

In some embodiments of any of the aspects, the detectable marker can be located anywhere within a CAR polypeptide as described herein. In one embodiment, the detectable marker is located between any domain of a CAR polypeptide as described herein, but is not found within a functional domain or does not disrupt the function of a domain. In some embodiments of any of the aspects, the detectable marker is located adjacent to and C terminal of the extracellular binding domain. Such a marker can be used to detect the expression of the CAR polypeptide, including the cell surface expression. In some embodiments of any of the aspects, the detectable marker is located adjacent to and C terminal of the extracellular binding domain and N terminal of the transmembrane domain (and hinge domain if present). In some embodiments of any of the aspects, the detectable marker that is located adjacent to and C terminal of the extracellular binding domain comprises the V5 tag, the Myc tag, or any other marker as described herein.

In some embodiments of any of the aspects, the detectable marker is located between the repressible protease and a protease cleavage site; such a marker can be used to detect the cleavage and/or expression of the CAR polypeptide. In some embodiments of any of the aspects, the detectable marker that is located between the repressible protease and a protease cleavage site comprises the AU1 tag, the HA1 tag, or any other marker as described herein.

In some embodiments of any of the aspects, the detectable marker is located adjacent and N-terminal to the repressible protease. In some embodiments of any of the aspects, the detectable marker is located adjacent and N-terminal to the repressible protease and C-terminal to a first protease cleavage site. In some embodiments of any of the aspects, the detectable marker is located adjacent to and C terminal to the repressible protease. In some embodiments of any of the aspects, the detectable marker is located adjacent to and C terminal to the repressible protease and N-terminal to a second protease cleavage site.

In some embodiments of any of the aspects, the detectable marker is located at the C-terminal end of the polypeptide. Such a marker can be used to detect the intracellular expression of the CAR polypeptide. In some embodiments of any of the aspects, the detectable marker located at the C-terminal end of the polypeptide comprises mCherry or another marker as described herein.

In some embodiments of any of the aspects, CAR polypeptides as described herein, especially those that are administered to a subject or those that are part of a pharmaceutical composition, do not comprise detectable markers that are immunogenic. In some embodiments of any of the aspects, CAR polypeptides as described herein do not comprise GFP, mCherry, HA1, or any other immunogenic markers.

In one aspect described herein is an ON-switch (also referred to as a drug-inducible) CAR polypeptide comprising: (a) an extracellular binding domain; (b) a transmembrane domain; (c) at least one intracellular signaling domain; and (d) a repressible protease. In some embodiments of any of the aspects, the extracellular binding domain (e.g., of the ON-switch CAR polypeptide) is N-terminal to the transmembrane domain, and the transmembrane domain to N-terminal to the intracellular domains (e.g., at least one intracellular signaling domain and a repressible protease). In some embodiments of any of the aspects, the at least one intracellular signaling domain (e.g., of the ON-switch CAR polypeptide) is N-terminal to the repressible protease. In some embodiments of any of the aspects, the repressible protease (e.g., of the ON-switch CAR polypeptide) is N-terminal to the at least one intracellular signaling domain. In some embodiments of any of the aspects, the repressible protease (e.g., of the ON-switch CAR polypeptide) is N-terminal to at least one intracellular signaling domain and C-terminal to at least one intracellular signaling domain.

In some embodiments of any of the aspects, the drug-inducible CAR polypeptide comprises 1, 2, 3, 4, 5, or more repressible protease(s). In some embodiments of any of the aspects, the drug-inducible CAR polypeptide comprises one repressible protease. In embodiments comprising multiple repressible proteases, the multiple repressible proteases can be different individual repressible proteases or multiple copies of the same repressible protease, or a combination of the foregoing. In some embodiments of any of the aspects, the drug-inducible CAR polypeptide comprises 1, 2, 3, 4, 5, or more intracellular signaling domains. In embodiments comprising multiple intracellular signaling domains, the multiple repressible proteases can be different individual intracellular signaling domains or multiple copies of the same intracellular signaling domain, or a combination of the foregoing. In some embodiments of any of the aspects, the repressible protease (e.g., of the ON-switch CAR polypeptide) is located: (a) between the transmembrane domain and the first intracellular signaling domain; (b) between the first intracellular signaling domain and the second intracellular signaling domain; or (c) between the second intracellular signaling domain and the third intracellular signaling domain.

In some embodiments of any of the aspects, the repressible protease (e.g., of the ON-switch CAR polypeptide) is located: (a) between the transmembrane domain and the first intracellular signaling domain. In some embodiments of any of the aspects, the repressible protease (e.g., of the ON-switch CAR polypeptide) is located: (b) between the first intracellular signaling domain and the second intracellular signaling domain. In some embodiments of any of the aspects, the repressible protease (e.g., of the ON-switch CAR polypeptide) is located: (c) between the second intracellular signaling domain and the third intracellular signaling domain.

In some embodiments of any of the aspects, the repressible protease (e.g., of the ON-switch CAR polypeptide) is located: (a) between the transmembrane domain and the first intracellular signaling domain; and (b) between the first intracellular signaling domain and the second intracellular signaling domain. In some embodiments of any of the aspects, the repressible protease (e.g., of the ON-switch CAR polypeptide) is located: (a) between the transmembrane domain and the first intracellular signaling domain; and (c) between the second intracellular signaling domain and the third intracellular signaling domain. In some embodiments of any of the aspects, the repressible protease (e.g., of the ON-switch CAR polypeptide) is located: (b) between the first intracellular signaling domain and the second intracellular signaling domain; and (c) between the second intracellular signaling domain and the third intracellular signaling domain. In some embodiments of any of the aspects, the repressible protease (e.g., of the ON-switch CAR polypeptide) is located: (a) between the transmembrane domain and the first intracellular signaling domain; (b) between the first intracellular signaling domain and the second intracellular signaling domain; and (c) between the second intracellular signaling domain and the third intracellular signaling domain.

In some embodiments of any of the aspects, the repressible protease (e.g., of the ON-switch CAR polypeptide) is hepatitis C virus (HCV) nonstructural protein 3 (NS3). In one embodiment, the repressible protease of the ON-switch CAR polypeptide comprises NS3 genotype 1A (e.g., SEQ ID NO: 16, 49). In some embodiments of any of the aspects, the repressible protease of an ON-switch CAR polypeptide as described herein comprises SEQ ID NO: 49, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 49 that maintains the same function. In some embodiments of any of the aspects, the repressible protease of an ON-switch CAR polypeptide as described herein comprises SEQ ID NO: 49, or an amino acid sequence that is at least 95% identical to the sequence of SEQ ID NO: 49 that maintains the same function.

In some embodiments of any of the aspects, the repressible protease of an ON-switch CAR polypeptide as described herein is encoded by a nucleic acid sequence comprising SEQ ID NO: 16, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 16 that maintains the same function or a codon-optimized version of SEQ ID NO: 16. In some embodiments of any of the aspects, the repressible protease of an ON-switch CAR polypeptide as described herein is encoded by a nucleic acid sequence comprising SEQ ID NO: 16, or a sequence that is at least 95% identical to SEQ ID NO: 16 that maintains the same function.

In some embodiments of any of the aspects, the repressible protease of the ON-switch CAR polypeptide is catalytically active. For NS3 genotype 1A, the catalytic triad comprises His-57, Asp-81, and Ser-139. In regard to a repressible protease, "catalytically active" refers to the ability to cleave at a protease cleavage site. In some embodiments of any of the aspects, the repressible protease (e.g., of the ON-switch CAR polypeptide) can be any repressible protease as described further herein.

In some embodiments of any of the aspects, the ON-switch CAR polypeptide further comprises a cofactor for the repressible protease. In some embodiments of any of the aspects, the cofactor (e.g., for NS3) is an HSV NS4A domain, as described further herein. In one embodiment, the ON-switch CAR polypeptide comprises genotype 1A NS4A (e.g., SEQ ID NO: 15, 48). In some embodiments of any of the aspects, the HSV NS4A domain is adjacent and N-terminal to the repressible protease (e.g., NS3).

In some embodiments of any of the aspects, the cofactor for the repressible protease of an ON-switch CAR polypeptide as described herein comprises SEQ ID NO: 48, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 48 that maintains the same function. In some embodiments of any of the aspects, the cofactor for the repressible protease of an ON-switch CAR polypeptide as described herein comprises SEQ ID NO: 48, or an amino acid sequence that is at least 95% identical to the sequence of SEQ ID NO: 48 that maintains the same function.

In some embodiments of any of the aspects, the cofactor for the repressible protease of an ON-switch CAR polypeptide as described herein is encoded by a nucleic acid sequence comprising SEQ ID NO: 15, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 15 that maintains the same function or a codon-optimized version of SEQ ID NO: 15. In some embodiments of any of the aspects, the cofactor for the repressible protease of an ON-switch CAR polypeptide as described herein is encoded by a nucleic acid sequence comprising SEQ ID NO: 15, or a sequence that is at least 95% identical to SEQ ID NO: 15 that maintains the same function.

In some embodiments of any of the aspects, the ON-switch CAR polypeptide further comprises at least one protease cleavage site. As a non-limiting example, the ON-switch CAR polypeptide can comprise 1, 2, 3, 4, 5, or more protease cleavage sites, in between or within any domain(s) as described herein. In one embodiment, the ON-switch CAR polypeptide comprises two protease cleavage sites. In some embodiments of any of the aspects, the repressible protease and the at least one protease cleavage site are located adjacent to each other in the same contiguous polypeptide. In some embodiments of any of the aspects, a first protease cleavage site is located 5' or N-terminal of the repressible protease. In some embodiments of any of the aspects, a second protease cleavage site is located 3' or C-terminal of the repressible protease. In some embodiments of any of the aspects, the protease cleavage site of the ON-switch CAR polypeptide comprises an NS5A/5B cut site (SEQ ID NO: 12, 45) and/or an NS4A/5B cut site (SEQ ID NO: 17, 50), or any other protease cleavage site as described herein. In some embodiments of any of the aspects, the ON-switch CAR polypeptide comprises an NS5A/5B cut site (SEQ ID NO: 12, 45) N-terminal of the repressible, and an NS4A/5B cut site (SEQ ID NO: 17, 50) C-terminal of the repressible protease. In some embodiments of any of the aspects, the repressible protease and the at least one protease cleavage site are not necessarily located adjacent to each other in the same contiguous polypeptide.

In some embodiments of any of the aspects, the protease cleavage site of an ON-switch CAR polypeptide as described herein comprises SEQ ID NOs: 45 or 50, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 45 or 50 that maintains the same functions as one of SEQ ID NOs: 45 or 50. In some embodiments of any of the aspects, the protease cleavage site of an ON-switch CAR polypeptide as described herein comprises SEQ ID NOs: 45 or 50, or an amino acid sequence that is at least 95% identical to the sequence of one of SEQ ID NOs: 45 or 50 that maintains the same function.

In some embodiments of any of the aspects, the protease cleavage site of an ON-switch CAR polypeptide as described herein is encoded by a nucleic acid sequence comprising SEQ ID NOs: 12 or 17, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to one of SEQ ID NOs: 12 or 17 that maintains the same function or a codon-optimized version of one of SEQ ID NO: 12 or 17. In some embodiments of any of the aspects, the protease cleavage site of an ON-switch CAR polypeptide as described herein is encoded by a nucleic acid sequence comprising SEQ ID NOs: 12 or 17, or a sequence that is at least 95% identical to one of SEQ ID NOs: 12 or 17 that maintains the same function.

In some embodiments of any of the aspects, the at least one protease cleavage site (e.g., of the ON-switch CAR polypeptide) is located: (a) between the transmembrane domain and the first intracellular signaling domain; (b) between the first intracellular signaling domain and the second intracellular signaling domain; or (c) between the second intracellular signaling domain and the third intracellular signaling domain. In some embodiments of any of the aspects, the at least one protease cleavage site (e.g., of the ON-switch CAR polypeptide) is located: (a) between the transmembrane domain and the first intracellular signaling domain. In some embodiments of any of the aspects, the at least one protease cleavage site (e.g., of the ON-switch CAR polypeptide) is located: (b) between the first intracellular signaling domain and the second intracellular signaling domain. In some embodiments of any of the aspects, the at least one protease cleavage site (e.g., of the ON-switch CAR polypeptide) is located: (c) between the second intracellular signaling domain and the third intracellular signaling domain. In some embodiments of any of the aspects, the at least one protease cleavage site (e.g., of the ON-switch CAR polypeptide) is located: (a) between the transmembrane domain and the first intracellular signaling domain; and (b) between the first intracellular signaling domain and the second intracellular signaling domain. In some embodiments of any of the aspects, the at least one protease cleavage site (e.g., of the ON-switch CAR polypeptide) is located: (a) between the transmembrane domain and the first intracellular signaling domain; and (c) between the second intracellular signaling domain and the third intracellular signaling domain. In some embodiments of any of the aspects, the at least one protease cleavage site (e.g., of the ON-switch CAR polypeptide) is located: (b) between the first intracellular signaling domain and the second intracellular signaling domain; and (c) between the second intracellular signaling domain and the third intracellular signaling domain. In some embodiments of any of the aspects, the at least one protease cleavage site (e.g., of the ON-switch CAR polypeptide) is located: (a) between the transmembrane domain and the first intracellular signaling domain; (b) between the first intracellular signaling domain and the second intracellular signaling domain; and (c) between the second intracellular signaling domain and the third intracellular signaling domain.

In some embodiments of any of the aspects, the ON-switch CAR polypeptide is cleaved when a protease inhibitor is not bound to the repressible protease. In some embodiments of any of the aspects, the protease cleavage site is located or engineered such that, when the ON-switch CAR polypeptide cleaves itself in the absence of a protease inhibitor, the resulting amino acid at the N-terminus of the newly cleaved polypeptide(s) causes the polypeptide(s) to degrade at a faster rate and have a shorter half-life compared to other cleaved polypeptides, according to the N-end rule as described further herein. In one embodiment, the N-terminal amino acid of the cleaved polypeptide (e.g., the ON-switch CAR polypeptide) is histidine. In some embodiments of any of the aspects, the amino acid immediately C-terminal of the cleavage site is a histidine.

In some embodiments of any of the aspects, the ON-switch CAR polypeptide is in combination with a protease inhibitor bound to the repressible protease. In some embodiments of any of the aspects, the ON-switch CAR polypeptide is bound to a protease inhibitor bound to the repressible protease. In some embodiments of any of the aspects, the ON-switch CAR polypeptide is bound specifically to a protease inhibitor bound to the repressible protease. Non-limiting examples of protease inhibitors (e.g., for NS3) include grazoprevir (GZV), danoprevir, simeprevir, asunaprevir, ciluprevir, boceprevir, sovaprevir, paritaprevir, ombitasvir, paritaprevir, ritonavir, dasabuvir, and telaprevir; further examples are described herein. In some embodiments of any of the aspects, the ON-switch CAR polypeptide is not cleaved (i.e., does not cleave itself) when the protease inhibitor is bound to the repressible protease.

In some embodiments of any of the aspects, the ON-switch CAR polypeptide is referred to as a "version 1" or "V 1" polypeptide. In some embodiments of any of the aspects, the V 1 CAR polypeptide comprises from the N-terminus to the C-terminus: (a) an extracellular binding domain; (b) a transmembrane domain; (c) a first protease cleavage site; (d) a repressible protease; (e) a second protease cleavage site; and (f) at least one intracellular signaling domain. In some embodiments of any of the aspects, the V1 CAR polypeptide comprises 1, 2, 3, 4, or at least 5 intracellular signaling domains. In some embodiments of any of the aspects, the V1 CAR polypeptide does not comprise the first protease cleavage site but does comprise the second protease cleavage site. In some embodiments of any of the aspects, the V1 CAR polypeptide does not comprise the second protease cleavage site but does comprise the first protease cleavage site.

In some embodiments of any of the aspects, the V1 CAR polypeptide comprises from the N-terminus to the C-terminus: (a) an extracellular binding domain; (b) a transmembrane domain; (c) a first protease cleavage site; (d) a repressible protease; (e) a second protease cleavage site; (f) a first intracellular signaling domain; (g) a second intracellular signaling domain; and (h) a third intracellular signaling domain. In some embodiments of any of the aspects, the first, second, and third intracellular signaling domains comprise the intracellular signaling domains of CD28, 4-1BB, and CD3zeta, respectively. In some embodiments of any of the aspects, the V 1 CAR polypeptide comprises SEQ ID NO: 34 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 34 that maintains the same functions as SEQ ID NO: 34 (e.g., target cell binding, CD3zeta signaling, etc.). In some embodiments of any of the aspects, the V1 CAR polypeptide comprises SEQ ID NO: 34 or an amino acid sequence that is at least 95% identical to the sequence of SEQ ID NO: 34 that maintains the same function.

In some embodiments of any of the aspects, the V1 CAR polypeptide is encoded by a nucleic acid sequence comprising SEQ ID NO: 1 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 1 that maintains the same function or a codon-optimized version of SEQ ID NO: 1. In some embodiments of any of the aspects, the V1 CAR polypeptide is encoded by a nucleic acid sequence comprising SEQ ID NO: 1 or a sequence that is at least 95% identical to SEQ ID NO: 1 that maintains the same function.

In some embodiments of any of the aspects, the ON-switch CAR polypeptide is referred to as a "version 2" or "V2" polypeptide. In some embodiments of any of the aspects, the V2 CAR polypeptide comprises from the N-terminus to the C-terminus: (a) an extracellular binding domain; (b) a transmembrane domain; (c) at least one intracellular signaling domain; (d) a first protease cleavage site; (e) a repressible protease; (f) a second protease cleavage site; and (g) at least one intracellular signaling domain. In some embodiments of any of the aspects, the V2 CAR polypeptide comprises 1, 2, 3, 4, or at least 5 intracellular signaling domains. In some embodiments of any of the aspects, the V2 CAR polypeptide does not comprise the first protease cleavage site but does comprise the second protease cleavage site. In some embodiments of any of the aspects, the V2 CAR polypeptide does not comprise the second protease cleavage site but does comprise the first protease cleavage site.

In some embodiments of any of the aspects, the V2 CAR polypeptide comprises from the N-terminus to the C-terminus: (a) an extracellular binding domain; (b) a transmembrane domain; (c) a first intracellular signaling domain; (d) a first protease cleavage site; (e) a repressible protease; (f) a second protease cleavage site; (g) a second intracellular signaling domain; and (h) a third intracellular signaling domain. In some embodiments of any of the aspects, the first, second, and third intracellular signaling domains comprise the intracellular signaling domains of CD28, 4-1BB, and CD3zeta, respectively.

In some embodiments of any of the aspects, the V2 CAR polypeptide comprises SEQ ID NO: 35 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 35 that maintains the same functions as SEQ ID NO: 35 (e.g., target cell binding, CD3zeta signaling, etc.). In some embodiments of any of the aspects, the V2 CAR polypeptide comprises SEQ ID NO: 35 or an amino acid sequence that is at least 95% identical to the sequence of SEQ ID NO: 35 that maintains the same function.

In some embodiments of any of the aspects, the V2 CAR polypeptide is encoded by a nucleic acid sequence comprising SEQ ID NO: 2 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% similar to SEQ ID NO: 2 that maintains the same function or a codon-optimized version of SEQ ID NO: 2. In some embodiments of any of the aspects, the V2 CAR polypeptide is encoded by a nucleic acid sequence comprising SEQ ID NO: 2 or a sequence that is at least 95% similar to SEQ ID NO: 2 that maintains the same function.

In some embodiments of any of the aspects, the ON-switch CAR polypeptide is referred to as a "version 3" or "V3" polypeptide. In some embodiments of any of the aspects, the V3 CAR polypeptide comprises from the N-terminus to the C-terminus: (a) an extracellular binding domain; (b) a transmembrane domain; (c) at least one intracellular signaling domain; (d) a first protease cleavage site; (e) a repressible protease; (f) a second protease cleavage site; and (g) at least one intracellular signaling domain. In some embodiments of any of the aspects, the V3 CAR polypeptide comprises 1, 2, 3, 4, or at least 5 intracellular signaling domains. In some embodiments of any of the aspects, the V3 CAR polypeptide does not comprise the first protease cleavage site but does comprise the second protease cleavage site. In some embodiments of any of the aspects, the V3 CAR polypeptide does not comprise the second protease cleavage site but does comprise the first protease cleavage site.

In some embodiments of any of the aspects, the V3 CAR polypeptide comprises from the N-terminus to the C-terminus: (a) an extracellular binding domain; (b) a transmembrane domain; (c) a first intracellular signaling domain; (d) a second intracellular signaling domain; (e) a first protease cleavage site; (f) a repressible protease; (g) a second protease cleavage site; and (h) a third intracellular signaling domain. In some embodiments of any of the aspects, the first, second, and third intracellular signaling domains comprise the intracellular signaling domains of CD28, 4-1BB, and CD3zeta, respectively.

In some embodiments of any of the aspects, the V3 CAR polypeptide comprises SEQ ID NO: 36 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 36 that maintains the same functions as SEQ ID NO: 36 (e.g., target cell binding, CD3zeta signaling, etc.). In some embodiments of any of the aspects, the V3 CAR polypeptide comprises SEQ ID NO: 36 or an amino acid sequence that is at least 95% identical to the sequence of SEQ ID NO: 36 that maintains the same function.

In some embodiments of any of the aspects, the V3 CAR polypeptide is encoded by a nucleic acid sequence comprising SEQ ID NO: 3 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% similar to SEQ ID NO: 3 that maintains the same function or a codon-optimized version of SEQ ID NO: 3. In some embodiments of any of the aspects, the V3 CAR polypeptide is encoded by a nucleic acid sequence comprising SEQ ID NO: 3 or a sequence that is at least 95% similar to SEQ ID NO: 3 that maintains the same function.

In some embodiments of any of the aspects, the extracellular binding domain of the ON-switch CAR polypeptide is an antibody, an antigen-binding fragment thereof, a F(ab) fragment, a F(ab') fragment, a single chain variable fragment (scFv), or a single-domain antibody (sdAb). In some embodiments of any of the aspects, the extracellular binding domain of the ON-switch CAR polypeptide comprises a scFv. In some embodiments of any of the aspects, the extracellular binding domain of the ON-switch CAR polypeptide specifically binds to a tumor antigen, as described further herein. In some embodiments of any of the aspects, the ON-switch CAR polypeptide comprises a leading peptide located N-terminal to the extracellular binding domain. In some embodiments of any of the aspects, the leading peptide is CD8alpha leading peptide or another leading peptide as described herein.

In some embodiments of any of the aspects, the transmembrane domain is located between the extracellular binding domain and the at least one intracellular signaling domain. The transmembrane domain of the ON-switch CAR polypeptide can be any known transmembrane domain. In one embodiment, the transmembrane domain of the ON-switch CAR polypeptide comprises the transmembrane domain of CD28. In some embodiments of any of the aspects, the ON-switch CAR polypeptide comprises a spacer domain located between the extracellular binding domain and the transmembrane domain. In some embodiments of any of the aspects, the spacer domain comprises a CD8a hinge domain or another spacer domain as described herein.

In some embodiments of any of the aspects, the ON-switch CAR polypeptide comprises 1, 2, 3, 4, 5, or more intracellular signaling domains. In some embodiments of any of the aspects, the at least one intracellular signaling domain (e.g., of the ON-switch CAR polypeptide) comprises a first and second intracellular signaling domains (e.g., a second generation CAR). In some embodiments of any of the aspects, the at least one intracellular signaling domain (e.g., of the ON-switch CAR polypeptide) comprises a first, second, and third intracellular signaling domains (e.g., a third or fourth generation CAR). In some embodiments of any of the aspects, each of the at least one intracellular signaling domains (e.g., of the ON-switch CAR polypeptide) independently comprises an intracellular signaling domain selected from the group consisting of: TCRC; FcRy; FcRp; CD3zeta; CD3y; CD35; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-L1); CD278 (ICOS); DAP10; LAT; KD2C SLP76; TRIM; ZAP70; and 41BB. In some embodiments of any of the aspects, the first, second, and third intracellular signaling domains (e.g., of the V1, V2, and V3 CARs) comprise the intracellular signaling domains of CD28, 4-1BB, and CD3zeta, respectively.

In some embodiments of any of the aspects, the ON-switch CAR polypeptide comprises at least one detectable marker as described herein. As a non-limiting example, the at least one detectable marker can be used to detect the expression of the CAR and/or the cleavage or degradation of the ON-switch CAR polypeptide. In some embodiments of any of the aspects, the ON-switch CAR polypeptide comprises a detectable marker adjacent to and C terminal of the extracellular binding domain. In some embodiments of any of the aspects, the ON-switch CAR polypeptide comprises a detectable marker adjacent and N-terminal to the repressible protease. In some embodiments of any of the aspects, the ON-switch CAR polypeptide comprises a detectable marker adjacent to and C terminal to the repressible protease. As a non-limiting example, the detectable marker(s) can be selected from GFP, V5, HA1, Myc, VSV-G, HSV, FLAG, HIS, mCherry, AU1, and biotin or another detectable marker as described herein (see e.g., Table 1).

In some embodiments of any of the aspects, an ON-switch CAR polypeptide as described herein is encoded by a nucleic acid sequence comprising one of SEQ ID NOs: 1-3 or a nucleic acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 1-3. In some embodiments of any of the aspects, an ON-switch CAR polypeptide as described herein is encoded by a nucleic acid sequence that is at least 95% identical to the sequence of one of SEQ ID NOs: 1-3.

In some embodiments of any of the aspects, an ON-switch CAR polypeptide as described herein comprises one of SEQ ID NOs: 34-36 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 34-36 that maintains the same functions as the sequence selected from SEQ ID NOs: 34-36 (e.g., target cell binding, CD3zeta signaling, etc.). In some embodiments of any of the aspects, an ON-switch CAR polypeptide as described herein comprises an amino acid sequence that is at least 95% identical to the sequence of one of SEQ ID NOs: 34-36 that maintains the same function.

Table 1 shows the locations of specific domains in exemplary ON-Switch CAR sequences. The nucleic acid numbers are shown first, followed by the amino acid residues.

example, the AND-gate CAR system described herein is functional and results in intracellular signaling only in the presence of a protease inhibitor and a degron stabilizer. Such an AND-gate CAR allows for fine-tuned control of CAR activation through modulating the levels of the first polypeptide, the second polypeptide, the protease inhibitor, and the degron stabilizer.

In one aspect described herein is a first polypeptide of an AND-gate CAR system, comprising: (a) an extracellular binding domain; (b) a transmembrane domain; (c) a repressible protease; and (d) an intracellular signaling domain. In some embodiments of any of the aspects, the extracellular binding domain (e.g., of the first polypeptide of an AND-gate CAR system) is N-terminal to the transmembrane domain, and the transmembrane domain to N-terminal to the intracellular domains (e.g., intracellular signalling domain and the repressible protease). In some embodiments of any of the aspects, the intracellular signaling domain (e.g., of the first polypeptide of an AND-gate CAR system) is N-terminal to the repressible protease. In some embodiments of any of the aspects, the repressible protease (e.g., of the first polypeptide of an AND-gate CAR system) is N-terminal to the intracellular signaling domain.

In some embodiments of any of the aspects, the first AND-gate CAR polypeptide comprises 1, 2, 3, 4, 5, or more repressible protease(s). In one embodiment, the first AND-gate CAR polypeptide comprises one repressible protease. In embodiments comprising multiple repressible proteases, the multiple repressible proteases can be different individual

TABLE 1

ON-Switch CAR Sequences

| Element (SEQ ID NOs) | NS3CAR-V1 (SEQ ID NO: 1, 34) | NS3CAR-V2 (SEQ ID NO: 2, 35) | NS3CAR-V3 (SEQ ID NO: 3, 36) | Traditional CAR (SEQ ID NO: 4, 37) |
|---|---|---|---|---|
| CD8a leading peptide (7, 40) | 1-63, 1-20 | 1-63, 1-20 | 1-63, 1-20 | 1-63, 1-20 |
| H3B1 scFv (8, 41) | 64-891, 21-296 | 64-891, 21-296 | 64-891, 21-296 | 64-891, 21-296 |
| V5 tag (9, 42) | 892-933, 297-310 | 892-933, 297-310 | 892-933, 297-310 | 892-933, 297-310 |
| CD8 hinge (10, 43) | 946-1080, 315-359 | 946-1080, 315-359 | 946-1080, 315-359 | 946-1080, 315-359 |
| CD28 transmembrane (11, 44) | 1081-1161, 360-386 | 1081-1161, 360-386 | 1081-1161, 360-386 | 1081-1161, 360-386 |
| NS5A/5B cut site (CC) (12, 45) | 1162-1191, 387-396 | 1285-1314, 428-437 | 1411-1440, 470-479 | |
| N-end rule (13, 46) | 1180-1203, 393-400 | 1303-1326, 434-441 | 1429-1452, 476-483 | |
| AU1 (14, 47) | 1213-1230, 404-409 | 1336-1353, 445-450 | 1462-1479, 487-492 | |
| NS4A (15, 48) | 1246-1484, 415-427 | 1369-1407, 456-468 | 1495-1533, 498-510 | |
| NS3 (16, 49) | 1297-1863, 432-620 | 1420-1986, 473-661 | 1546-2112, 515-703 | |
| NS4A/4B cut site (CS) (17, 50) | 1915-1956, 638-651 | 2038-2079, 679-692 | 2164-2205, 722-735 | |
| HA1 (18, 51) | 1957-1983, 652-660 | 2080-2106, 693-701 | 2206-2232, 735-743 | |
| CD28 ICD (19, 52) | 1984-2106, 661-701 | 1162-1284, 387-427 | 1162-1284, 387-427 | 1162-1284, 387-427 |
| 41BB ICD (20, 53) | 2107-2232, 702-743 | 2107-2232, 702-743 | 1285-1410, 428-469 | 1285-1410, 428-469 |
| CD3z ICD (21, 54) | 2233-2568, 744-855 | 2233-2568, 744-855 | 2233-2568, 744-855 | 1411-1746, 470-581 |

In several aspects, described herein are two-component CAR polypeptide systems, with one CAR polypeptide comprising a repressible protease and at least one intracellular signalling domain, and a second CAR polypeptide comprising a degron domain and at least one other intracellular signalling domain. Such a two-component CAR polypeptide system can also be referred to as an "AND logic gate" or simply "AND gate." AND gates have two inputs. The output of an AND gate is on only if both inputs are on. If at least one of the inputs are off, the output will be off. Accordingly, a two-component CAR polypeptide system does not result in intracellular signalling if either of the two polypeptides are absent or inactive or their cognate antigens are not both present in close proximity on a target cell. As a non-limiting repressible proteases or multiple copies of the same repressible protease, or a combination of the foregoing. In some embodiments of any of the aspects, the repressible protease (e.g., of the first AND-gate CAR polypeptide) is located between the transmembrane domain and the intracellular signaling domain.

In some embodiments of any of the aspects, the repressible protease (e.g., of the first AND-gate CAR polypeptide) is hepatitis C virus (HCV) nonstructural protein 3 (NS3). In one embodiment, the repressible protease of the first AND-gate CAR polypeptide comprises NS3 genotype 1A (e.g., SEQ ID NO: 16, 49). In some embodiments of any of the aspects, the repressible protease of the first AND-gate CAR polypeptide as described herein comprises SEQ ID NO: 49, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 49 that maintains the same function. In some embodiments of any of the aspects, the repressible protease of the first AND-gate CAR polypeptide as described herein comprises SEQ ID NO: 49, or an amino acid sequence that is at least 95% identical to the sequence of SEQ ID NO: 49 that maintains the same function.

In some embodiments of any of the aspects, the repressible protease of the first AND-gate CAR polypeptide as described herein is encoded by a nucleic acid sequence comprising SEQ ID NO: 16, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 16 that maintains the same function or a codon-optimized version of SEQ ID NO: 16. In some embodiments of any of the aspects, the repressible protease the first AND-gate CAR polypeptide as described herein is encoded by a nucleic acid sequence comprising SEQ ID NO: 16, or a sequence that is at least 95% identical to SEQ ID NO: 16 that maintains the same function.

In some embodiments of any of the aspects, the repressible protease of the first AND-gate CAR polypeptide is catalytically active. For NS3 genotype 1A, the catalytic triad comprises His-57, Asp-81, and Ser-139. In regard to a repressible protease, "catalytically active" refers to the ability to cleave at a protease cleavage site. In some embodiments of any of the aspects, the repressible protease (e.g., of the first AND-gate CAR polypeptide) can be any repressible protease as described further herein.

In some embodiments of any of the aspects, the first AND-gate CAR polypeptide further comprises a cofactor for the repressible protease. In some embodiments of any of the aspects, the cofactor (e.g., for NS3) is an HSV NS4A domain, as described further herein. In one embodiment, the first AND-gate CAR polypeptide comprises genotype 1A NS4A (e.g., SEQ ID NO: 15, 48). In some embodiments of any of the aspects, the HSV NS4A domain is adjacent and N-terminal to the repressible protease (e.g., NS3).

In some embodiments of any of the aspects, the cofactor for the repressible protease of the first AND-gate CAR polypeptide as described herein comprises SEQ ID NO: 48, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 48 that maintains the same function. In some embodiments of any of the aspects, the cofactor for the repressible protease of first AND-gate CAR polypeptide as described herein comprises SEQ ID NO: 48, or an amino acid sequence that is at least 95% identical to the sequence of SEQ ID NO: 48 that maintains the same function.

In some embodiments of any of the aspects, the cofactor for the repressible protease of the first AND-gate CAR polypeptide as described herein is encoded by a nucleic acid sequence comprising SEQ ID NO: 15, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 15 that maintains the same function or a codon-optimized version of SEQ ID NO: 15. In some embodiments of any of the aspects, the cofactor for the repressible protease of first AND-gate CAR polypeptide as described herein is encoded by a nucleic acid sequence comprising SEQ ID NO: 15, or a sequence that is at least 95% identical to SEQ ID NO: 15 that maintains the same function.

In some embodiments of any of the aspects, the first AND-gate CAR polypeptide further comprises at least one protease cleavage site. As a non-limiting example, the first AND-gate CAR polypeptide can comprise 1, 2, 3, 4, 5, or more protease cleavage sites, in between or within any domain(s) as described herein. In one embodiment, the first AND-gate CAR polypeptide comprises 2 protease cleavage sites. In some embodiments of any of the aspects, the repressible protease and the at least one protease cleavage site are located in the same contiguous polypeptide. In some embodiments of any of the aspects, the repressible protease and the at least one protease cleavage site are located adjacent to each other in the same contiguous polypeptide. In some embodiments of any of the aspects, a first protease cleavage site is located 5' or N-terminal of the repressible protease. In some embodiments of any of the aspects, a second protease cleavage site is located 3' or C-terminal of the repressible protease. In some embodiments of any of the aspects, the protease cleavage site of the first AND-gate CAR polypeptide comprises an NS5A/5B cut site (SEQ ID NO: 12, 45) and/or an NS4A/5B cut site (SEQ ID NO: 17, 50), or any other protease cleavage site as described herein. In some embodiments of any of the aspects, the first AND-gate CAR polypeptide comprises an NS5A/5B cut site (SEQ ID NO: 12, 45) N-terminal of the repressible, and an NS4A/5B cut site (SEQ ID NO: 17, 50) C-terminal of the repressible protease. In some embodiments of any of the aspects, the repressible protease and the at least one protease cleavage site are not located adjacent to each other in the same contiguous polypeptide.

In some embodiments of any of the aspects, the protease cleavage site of the first AND-gate CAR polypeptide as described herein comprises SEQ ID NOs: 45 or 50, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 45 or 50 that maintains the same functions as one of SEQ ID NOs: 45 or 50. In some embodiments of any of the aspects, the protease cleavage site of the first AND-gate CAR polypeptide as described herein comprises SEQ ID NOs: 45 or 50, or an amino acid sequence that is at least 95% identical to the sequence of one of SEQ ID NOs: 45 or 50 that maintains the same function.

In some embodiments of any of the aspects, the protease cleavage site of the first AND-gate CAR polypeptide as described herein is encoded by a nucleic acid sequence comprising SEQ ID NOs: 12 or 17, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to one of SEQ ID NOs: 12 or 17 that maintains the same function or a codon-optimized version of one of SEQ ID NO: 12 or 17. In some embodiments of any of the aspects, the protease cleavage site of the first AND-gate CAR polypeptide as described herein is encoded by a nucleic acid sequence comprising SEQ ID NOs: 12 or 17, or a sequence that is at least 95% identical to one of SEQ ID NOs: 12 or 17 that maintains the same function.

In some embodiments of any of the aspects, the at least one protease cleavage site (e.g., of the first AND-gate CAR polypeptide) is located between the transmembrane domain and the intracellular signaling domain. In some embodiments of any of the aspects, the at least one protease cleavage site (e.g., of the first AND-gate CAR polypeptide) is located: (a) between the transmembrane domain and the repressible protease; or (b) between the repressible protease and the intracellular signaling domain. In some embodiments of any of the aspects, the at least one protease cleavage site (e.g., of the first AND-gate CAR polypeptide) is located: (a) between the transmembrane domain and the repressible protease. In some embodiments of any of the aspects, the at least one protease cleavage site (e.g., of the first AND-gate CAR polypeptide) is located: (b) between the repressible protease and the intracellular signaling domain. In some embodiments of any of the aspects, the at least one protease cleavage site (e.g., of the first AND-gate CAR polypeptide) is located: (a) between the transmembrane domain and the repressible protease; and (b) between the repressible protease and the intracellular signaling domain.

In some embodiments of any of the aspects, the first AND-gate CAR polypeptide is cleaved when a protease inhibitor is not bound to the repressible protease. In some embodiments of any of the aspects, the protease cleavage site is located or engineered such that, when the first AND-gate CAR polypeptide cleaves itself in the absence of a protease inhibitor, the resulting amino acid at the N-terminus of the newly cleaved polypeptide(s) causes the polypeptide(s) to degrade at a faster rate and have a shorter half-life compared to other cleaved polypeptides, according to the N-end rule as described further herein. In one embodiment, the N-terminal amino acid of the cleaved polypeptide (e.g., the first AND-gate CAR polypeptide) is histidine. In some embodiments of any of the aspects, the amino acid immediately C-terminal of the cleavage site is a histidine.

In some embodiments of any of the aspects, the first AND-gate CAR polypeptide is in combination with a protease inhibitor bound to the repressible protease. In some embodiments of any of the aspects, the first AND-gate CAR polypeptide is bound to a protease inhibitor bound to the repressible protease. In some embodiments of any of the aspects, the first AND-gate CAR polypeptide is bound specifically to a protease inhibitor bound to the repressible protease. Non-limiting examples of protease inhibitors (e.g., for NS3) include grazoprevir (GZV), danoprevir, simeprevir, asunaprevir, ciluprevir, boceprevir, sovaprevir, paritaprevir, ombitasvir, paritaprevir, ritonavir, dasabuvir, and telaprevir; further examples are described herein. In some embodiments of any of the aspects, the first AND-gate CAR polypeptide is not cleaved (i.e., does not cleave itself) when the protease inhibitor is bound to the repressible protease.

In some embodiments of any of the aspects, the first AND-gate CAR polypeptide comprises from the N-terminus to the C-terminus: (a) an extracellular binding domain; (b) a transmembrane domain; (c) a first protease cleavage site; (d) a repressible protease; (e) a second protease cleavage site; and (f) a single intracellular signaling domain.

In some embodiments of any of the aspects, the extracellular binding domain of the first AND-gate CAR polypeptide is an antibody, an antigen-binding fragment thereof, a F(ab) fragment, a F(ab') fragment, a single chain variable fragment (scFv), or a single-domain antibody (sdAb). In some embodiments of any of the aspects, the extracellular binding domain of the first AND-gate CAR polypeptide comprises a scFv. In some embodiments of any of the aspects, the extracellular binding domain of the first AND-gate CAR polypeptide binds to a tumor antigen, as described further herein. In some embodiments of any of the aspects, the first AND-gate CAR polypeptide comprises a leading peptide located N-terminal to the extracellular binding domain. In some embodiments of any of the aspects, the leading peptide is CD8alpha leading peptide or another leading peptide as described herein.

In some embodiments of any of the aspects, the transmembrane domain is located between the extracellular binding domain and the at least one intracellular signaling domain. The transmembrane domain of the first AND-gate CAR polypeptide can be any known transmembrane domain. In one embodiment, the transmembrane domain of the first AND-gate CAR polypeptide comprises the transmembrane domain of CD28. In some embodiments of any of the aspects, the first AND-gate CAR polypeptide comprises a spacer domain located between the extracellular binding domain and the transmembrane domain. In some embodiments of any of the aspects, the spacer domain comprises a CD8a hinge domain or another spacer domain as described herein.

In some embodiments of any of the aspects, the first AND-gate CAR polypeptide comprises 1, 2, 3, 4, 5, or more intracellular signaling domains. In one embodiment, the first AND-gate CAR polypeptide comprises a single intracellular signaling domain. In some embodiments of any of the aspects, the intracellular signaling domain (e.g., of the first AND-gate CAR polypeptide) comprises at least one intracellular signaling domain selected from the group consisting of: TCRC; FcRy; FcRp; CD3zeta; CD3y; CD35; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-L1); CD278 (ICOS); DAP10; LAT; KD2C SLP76; TRIM; ZAP70; and 41BB. In some embodiments of any of the aspects, the intracellular signaling domain of the first AND-gate CAR polypeptide comprises the intracellular signaling domain of CD3zeta. In some embodiments of any of the aspects, the first AND-gate CAR polypeptide further comprises the intracellular signaling domain of 4-1BB, which can be located N-terminal or C-terminal of the CD3zeta domain.

In some embodiments of any of the aspects, the first AND-gate CAR polypeptide comprises at least one detectable marker as described herein. As a non-limiting example, the at least one detectable marker can be used to detect the expression of the CAR and/or the cleavage or degradation of the first AND-gate CAR polypeptide. In some embodiments of any of the aspects, the first AND-gate CAR polypeptide comprises a detectable marker adjacent to and C terminal of the extracellular binding domain. In some embodiments of any of the aspects, the first AND-gate CAR polypeptide comprises a detectable marker adjacent and N-terminal to the repressible protease. In some embodiments of any of the aspects, the first AND-gate CAR polypeptide comprises a detectable marker adjacent to and C terminal to the repressible protease. As a non-limiting example, the detectable marker(s) can be selected from GFP, V5, HA1, Myc, VSV-G, HSV, FLAG, HIS, mCherry, AU1, and biotin or another detectable marker as described herein (see e.g., Table 2).

In some embodiments of any of the aspects, the first AND-gate CAR polypeptide comprises SEQ ID NO: 38 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 38 that maintains the same functions as SEQ ID NO: 38 (e.g., target cell binding, CD3zeta signaling, etc.). In some embodiments of any of the aspects, the first AND-gate CAR polypeptide comprises SEQ ID NO: 38 or an amino acid sequence that is at least 95% identical to the sequence of SEQ ID NO: 38 that maintains the same function.

In some embodiments of any of the aspects, the first AND-gate CAR polypeptide is encoded by a nucleic acid sequence comprising SEQ ID NO: 5 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 5 that maintains the same function or a codon-optimized version of SEQ ID NO: 5. In some embodiments of any of the aspects, the first AND-gate CAR polypeptide is encoded by a nucleic acid sequence comprising SEQ ID NO: 5 or a sequence that is at least 95% identical to SEQ ID NO: 5 that maintains the same function.

Table 2 shows the locations of specific domains in exemplary AND-Gate CAR sequences. The nucleic acid numbers are shown first, followed by the amino acid residues.

In some embodiments of any of the aspects, the second AND-gate CAR polypeptide comprises 1, 2, 3, 4, 5, or more degron domain(s). In one embodiment, the second AND-gate CAR polypeptide comprises one degron domain. In embodiments comprising multiple degron domains, the multiple degron domains can be different individual degron domains or multiple copies of the same degron domain, or a combination of the foregoing.

In some embodiments of any of the aspects, the degron domain (e.g., of the second AND-gate CAR polypeptide) comprises a dihydrofolate reductase (DHFR) degron (DD; e.g., SEQ ID NOs: 26, 59) or another degron domain as described further herein. In some embodiments of any of the aspects, the degron domain (e.g., of the second AND-gate CAR polypeptide) is located C terminal to the intracellular signaling domain. In some embodiments of any of the aspects, the degron domain (e.g., of the second AND-gate CAR polypeptide) is located between the transmembrane domain and the intracellular signaling domain.

In some embodiments of any of the aspects, the degron domain of the second AND-gate CAR polypeptide as described herein comprises SEQ ID NO: 59 or an amino acid sequence that is at least 70%, at least 75%, at least 80%, at

TABLE 2

AND-Gate CAR Sequences

| Element (SEQ ID NOs) | ANDgate-NS3 (SEQ ID NO: 5, 38) | ANDgate-DD (SEQ ID NO: 6, 39) |
|---|---|---|
| CD8a leading peptide (7, 40) | 1-63, 1-20 | 1-63, 1-20 |
| H3B1 scFv (8, 41) | 64-891, 21-296 | |
| V5 tag (9, 42) | 892-933, 297-310 | |
| h#11B7-T18 heavy chain (22, 55) | | 64-402, 21-133 |
| GS linker (23, 56) | | 403-447, 134-148 |
| h#11B7-T18 light chain (24, 57) | | 448-774, 149-257 |
| Myc tag (35, 58) | | 775-804, 258-267 |
| CD8 hinge (10, 43) | 946-1080, 315-359 | 817-951, 272-316 |
| CD28 transmembrane (11, 44) | 1081-1161, 360-386 | 952-1032, 317-343 |
| NS5A/5B cut site (CC) (12, 45) | 1162-1191, 387-396 | |
| N-end rule (13, 46) | 1180-1203, 393-400 | |
| AU1 (14, 47) | 1213-1230, 404-409 | |
| NS4A (15, 48) | 1246-1484, 415-427 | |
| NS3 (16, 49) | 1297-1863, 432-620 | |
| NS4A/4B cut site (CS) (17, 50) | 1915-1956, 638-651 | |
| HA1 (18, 51) | 1957-1983, 652-660 | |
| CD28 ICD (19, 52) | | 1033-1155, 344-384 |
| 41BB ICD (20, 53) | | |
| CD3z ICD (21, 54) | 1984-2319, 661-772 | |
| DHFR (V19A) (26, 59) | | 1159-1632, 386-543 |

In one aspect described herein is a second polypeptide of an AND-gate CAR system, comprising: (a) an extracellular binding domain; (b) a transmembrane domain; (c) at least one intracellular signaling domain; and (d) a degron domain. In some embodiments of any of the aspects, the extracellular binding domain (e.g., of the second polypeptide of an AND-gate CAR system) is N-terminal to the transmembrane domain, and the transmembrane domain to N-terminal to the intracellular domains (e.g., degron domain and at least one intracellular signaling domain). In some embodiments of any of the aspects, the at least one intracellular signaling domain (e.g., of the second polypeptide of an AND-gate CAR system) is N-terminal to the degron domain. In some embodiments of any of the aspects, the degron domain (e.g., of the second polypeptide of an AND-gate CAR system) is N-terminal to the at least one intracellular signaling domain. In some embodiments of any of the aspects, the degron domain (e.g., of the second polypeptide of an AND-gate CAR system) is N-terminal to at least one intracellular signaling domain and C-terminal to at least one intracellular signaling domain.

least 85%, at least 90%, at least 90%, at least 91%, at least 92%, at least 93%, at least 94%, at least 95%, at least 96%, at least 97%, at least 98%, or at least 99% identical to the sequence of SEQ ID NO: 59 that maintains the same functions as SEQ ID NO: 59 (e.g., degradation, binding to TMP). In some embodiments of any of the aspects, the degron domain of the second AND-gate CAR polypeptide as described herein comprises SEQ ID NO: 59 or an amino acid sequence that is at least 95% identical to the sequence of SEQ ID NO: 59 that maintains the same functions as SEQ ID NO: 59 (e.g., degradation, binding to TMP).

In some embodiments of any of the aspects, the degron domain of the second AND-gate CAR polypeptide as described herein is encoded by a nucleic acid sequence comprising SEQ ID NO: 26 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 26 that maintains the same function or a codon-optimized version of SEQ ID NO: 26. In some embodiments of any of the aspects, the degron domain of the second AND-gate CAR polypeptide as described herein is encoded by a nucleic acid sequence comprising SEQ ID NO: 26 or a sequence that is at least 95% identical to SEQ ID NO: 26 that maintains the same function.

In some embodiments of any of the aspects, the second AND-gate CAR polypeptide is in combination with a degron stabilizer bound to the degron domain. In some embodiments of any of the aspects, the second AND-gate CAR polypeptide is bound to a degron stabilizer bound to the degron domain. In some embodiments of any of the aspects, the second AND-gate CAR polypeptide is bound specifically to a degron stabilizer bound to the degron domain. The degron stabilizer can be selected from any known in the art. As a non-limiting example, the degron stabilizer is trimethoprim (TMP; e.g., PubChem CID: 5578). In some embodiments of any of the aspects, the second AND-gate CAR polypeptide is not degraded when the degron stabilizer is bound to the degron domain.

In some embodiments of any of the aspects, the second AND-gate CAR polypeptide is in combination with a degron destabilizer bound to the degron domain. In some embodiments of any of the aspects, the second AND-gate CAR polypeptide is bound to a degron destabilizer bound to the degron domain. In some embodiments of any of the aspects, the second AND-gate CAR polypeptide is bound specifically to a degron destabilizer bound to the degron domain. The degron destabilizer can be selected from any known in the art. As a non-limiting example, the degron is a ligand-induced degradation (LID) domain and the degron destabilizer is Shield-1 or an analog thereof. In some embodiments of any of the aspects, the second AND-gate CAR polypeptide is degraded when the degron destabilizer is bound to the degron domain.

In some embodiments of any of the aspects, the second AND-gate CAR polypeptide comprises from the N-terminus to the C-terminus: (a) an extracellular binding domain; (b) a transmembrane domain; (c) an intracellular signaling domain; and (d) a degron domain.

In some embodiments of any of the aspects, the extracellular binding domain of the second AND-gate CAR polypeptide is an antibody, an antigen-binding fragment thereof, a F(ab) fragment, a F(ab') fragment, a single chain variable fragment (scFv), or a single-domain antibody (sdAb). In some embodiments of any of the aspects, the extracellular binding domain of the second AND-gate CAR polypeptide comprises a scFv. In some embodiments of any of the aspects, the extracellular binding domain of the second AND-gate CAR polypeptide binds to a tumor antigen, as described further herein. In some embodiments of any of the aspects, the second AND-gate CAR polypeptide comprises a leading peptide located N-terminal to the extracellular binding domain. In some embodiments of any of the aspects, the leading peptide is CD8alpha leading peptide or another leading peptide as described herein.

In some embodiments of any of the aspects, the transmembrane domain is located between the extracellular binding domain and the at least one intracellular signaling domain. The transmembrane domain of the second AND-gate CAR polypeptide can be any known transmembrane domain. In some embodiments of any of the aspects, the transmembrane domain of the second AND-gate CAR polypeptide comprises the transmembrane domain of CD28. In some embodiments of any of the aspects, the second AND-gate CAR polypeptide comprises a spacer domain located between the extracellular binding domain and the transmembrane domain. In some embodiments of any of the aspects, the spacer domain comprises a CD8a hinge domain or another spacer domain as described herein.

In some embodiments of any of the aspects, the second AND-gate CAR polypeptide comprises 1, 2, 3, 4, 5, or more intracellular signaling domains. In embodiments comprising multiple intracellular signaling domains, the multiple repressible proteases can be different individual intracellular signaling domains or multiple copies of the same intracellular signaling domain, or a combination of the foregoing. In one embodiment, the second AND-gate CAR polypeptide comprises a single intracellular signaling domain. In some embodiments of any of the aspects, the intracellular signaling domain (e.g., of the second AND-gate CAR polypeptide) comprises an intracellular signaling domain selected from the group consisting of: TCRC; FcRy; FcRp; CD3zeta; CD3y; CD35; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-L1); CD278 (ICOS); DAP10; LAT; KD2C SLP76; TRIM; ZAP70; and 41BB. In some embodiments of any of the aspects, the intracellular signaling domain of the second AND-gate CAR polypeptide comprises the intracellular signaling domain of CD28. In some embodiments of any of the aspects, the second AND-gate CAR polypeptide further comprises the intracellular signaling domain of 4-1BB.

In some embodiments of any of the aspects, the second AND-gate CAR polypeptide comprises at least one detectable marker as described herein. As a non-limiting example, the at least one detectable marker can be used to detect the expression of the CAR and/or the cleavage or degradation of the second AND-gate CAR polypeptide. In some embodiments of any of the aspects, the second AND-gate CAR polypeptide comprises a detectable marker adjacent to and C terminal of the extracellular binding domain. As a non-limiting example, the detectable marker(s) can be selected from GFP, V5, HA1, Myc, VSV-G, HSV, FLAG, HIS, mCherry, AU1, and biotin or another detectable marker as described herein (see e.g., Table 2).

In some embodiments of any of the aspects, the second AND-gate CAR polypeptide comprises SEQ ID NO: 39 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 39 that maintains the same functions as SEQ ID NO: 39 (e.g., target cell binding, CD28 signaling, etc.). In some embodiments of any of the aspects, the second AND-gate CAR polypeptide comprises SEQ ID NO: 39 or an amino acid sequence that is at least 95% identical to the sequence of SEQ ID NO: 39 that maintains the same function.

In some embodiments of any of the aspects, the second AND-gate CAR polypeptide is encoded by a nucleic acid sequence comprising SEQ ID NO: 6 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 6 that maintains the same function or a codon-optimized version of SEQ ID NO: 6. In some embodiments of any of the aspects, the second AND-gate CAR polypeptide is encoded by a nucleic acid sequence comprising SEQ ID NO: 6 or a sequence that is at least 95% identical to SEQ ID NO: 6 that maintains the same function.

In one aspect, described herein is an AND-gate CAR system comprising the first and second AND-gate CAR polypeptides as described herein. Accordingly, the AND-gate CAR system comprises: (a) a first polypeptide comprising (e.g., from N-terminus to C-terminus): (i) an extracellular binding domain; (ii) a transmembrane domain; (iii) a repressible protease; and (iv) an intracellular signaling domain; and (b) a second polypeptide comprising (e.g., from N-terminus to C-terminus): (i) an extracellular binding domain; (ii) a transmembrane domain; (iii) an intracellular signaling domain; and (iv) a degron domain.

In some embodiments of any of the aspects, the AND-gate CAR system is functional (i.e., results in intracellular signaling) only in the presence of the protease inhibitor and the degron stabilizer. As a non-limiting example, the AND-gate CAR system is not functional in the following situations: (1) absence of both the protease inhibitor and the degron stabilizer; (2) absence of the protease inhibitor and presence of the degron stabilizer; and (3) presence of the protease inhibitor and absence of the degron stabilizer.

In some embodiments of any of the aspects, one polypeptide of the AND-gate CAR system comprises a repressible protease, and the other polypeptide of the AND-gate CAR system comprises a degron domain. In some embodiments of any of the aspects, one polypeptide of the AND-gate CAR system comprises an intracellular signaling domain, and the other polypeptide of the AND-gate CAR system comprises an intracellular signaling domain that is a co-stimulatory domain. The AND-gate CAR system can comprise any combination and assortment of repressible protease, degron domain, signaling domain, and co-stimulatory domain between the two polypeptides (see e.g., Table 6 for non-limiting examples). In some embodiments of any of the aspects, the first and second polypeptides of the AND-gate CAR system each comprise a repressible protease and/or a degron domain. In some embodiments of any of the aspects, one polypeptide of the AND-gate CAR system comprises the intracellular signaling domain of CD28, and the other polypeptide of the AND-gate CAR system comprises the intracellular signaling domain of CD3zeta.

In some embodiments of any of the aspects, the first polypeptide of the AND-gate CAR system comprises a signaling domain. In some embodiments of any of the aspects, the signaling domain (e.g., of the first polypeptide of the AND-gate CAR system) comprises the intracellular signaling domain of CD3zeta. In some embodiments of any of the aspects, the second polypeptide of the AND-gate CAR system comprises at least one co-stimulatory signaling domain. In some embodiments of any of the aspects, the co-stimulatory signaling domain (e.g., of the second polypeptide of the AND-gate CAR system) comprises the intracellular signaling domain of CD28. In some embodiments of any of the aspects, the co-stimulatory signaling domain (e.g., of the second polypeptide of the AND-gate CAR system) comprises the intracellular signaling domain of 4-1BB.

TABLE 6

Exemplary combinations of domains in the first (1st) and second (2nd) polypeptides of the AND-gate CAR system.

| | Pro. | Deg. | CD3z | CD28 | 41BB |
|---|---|---|---|---|---|
| 1st | x | | x | | |
| 2nd | | x | | x | |
| 1st | x | | x | | x |
| 2nd | | x | | x | |
| 1st | x | | x | | |
| 2nd | | x | | x | x |
| 1st | x | | x | | x |
| 2nd | | x | | x | x |
| 1st | | x | x | | |
| 2nd | x | | | x | |
| 1st | | x | x | | x |
| 2nd | x | | | x | |
| 1st | | x | x | | |
| 2nd | x | | | x | x |
| 1st | | x | x | | x |
| 2nd | x | | | x | x |
| 1st | x | | x | | |
| 2nd | x | | | x | |
| 1st | x | | x | | x |
| 2nd | x | | | x | |
| 1st | x | | x | | |
| 2nd | x | | | x | x |
| 1st | x | | x | | x |
| 2nd | x | | | x | x |
| 1st | | x | x | | |
| 2nd | | x | | x | |
| 1st | | x | x | | x |
| 2nd | | x | | x | |
| 1st | | x | x | | |
| 2nd | | x | | x | x |
| 1st | | x | x | | x |
| 2nd | | x | | x | x |
| 1st | x | x | x | | |
| 2nd | x | | | x | |
| 1st | x | x | x | | x |
| 2nd | x | | | x | |
| 1st | x | x | x | | |
| 2nd | x | | | x | x |
| 1st | x | x | x | | x |
| 2nd | x | | | x | x |
| 1st | x | | x | | |
| 2nd | x | x | | x | |
| 1st | x | | x | | x |
| 2nd | x | x | | x | |
| 1st | x | | x | | |
| 2nd | x | x | | x | x |
| 1st | x | | x | | x |
| 2nd | x | x | | x | x |
| 1st | x | x | x | | |
| 2nd | x | x | | x | |
| 1st | x | x | x | | x |
| 2nd | x | x | | x | |
| 1st | x | x | x | | |
| 2nd | x | x | | x | x |
| 1st | x | x | x | | x |
| 2nd | x | x | | x | x |
| 1st | x | | | x | |
| 2nd | | x | x | x | |
| 1st | x | | | | x |
| 2nd | | x | x | x | x |
| 1st | x | | | x | x |
| 2nd | | x | x | | x |
| 1st | x | | | | x |
| 2nd | x | | x | x | x |
| 1st | x | | x | x | x |
| 2nd | x | | | x | x |

TABLE 6-continued

Exemplary combinations of domains in the first (1st) and second (2nd) polypeptides of the AND-gate CAR system.

| | Pro. | Deg. | CD3z | CD28 | 41BB |
|---|---|---|---|---|---|
| 1st | | x | | | x |
| 2nd | x | | x | x | x |
| 1st | x | | | | x |
| 2nd | x | | x | x | |
| 1st | x | | | x | x |
| 2nd | x | | | | x |
| 1st | x | | x | x | x |
| 2nd | x | | | | x |
| 1st | x | | | | x |
| 2nd | x | | x | x | x |
| 1st | | x | | | x |
| 2nd | | x | x | x | |
| 1st | | x | x | x | |
| 2nd | | x | | | x |
| 1st | | x | x | x | x |
| 2nd | | x | | | x |
| 1st | | x | | | x |
| 2nd | | x | x | x | x |
| 1st | x | x | | | x |
| 2nd | | x | x | x | |
| 1st | | x | x | x | |
| 2nd | | x | | | x |
| 1st | x | x | x | x | x |
| 2nd | | x | | | x |
| 1st | | x | | | x |
| 2nd | | x | x | x | |
| 1st | | x | | | x |
| 2nd | x | x | x | x | |
| 1st | x | | | x | x |
| 2nd | | x | | | x |
| 1st | | | x | x | x |
| 2nd | x | x | | | x |
| 1st | x | | | | x |
| 2nd | | x | x | x | x |
| 1st | x | x | | | x |
| 2nd | | x | x | x | |
| 1st | x | x | x | x | |
| 2nd | | x | | | x |
| 1st | x | x | | | x |
| 2nd | | x | x | x | |
| 1st | x | x | | | x |
| 2nd | x | x | x | x | |
| 1st | x | x | x | x | |
| 2nd | x | x | | | x |
| 1st | x | x | | | x |
| 2nd | x | x | x | x | x |

"Pro." indicates the repressible protease, and "deg." indicates the degron domain. The domains shown in Table 6 are not necessarily shown in sequential order. Each polypeptide in Table 6 further comprises a transmembrane domain and an extracellular binding domain.

In some embodiments of any of the aspects, the extracellular binding domain of the first AND-gate CAR polypeptide binds to a tumor antigen that is the same as the tumor antigen that binds to the extracellular binding domain of the second AND-gate CAR polypeptide. In some embodiments of any of the aspects, the extracellular binding domain of the first AND-gate CAR polypeptide binds to a tumor antigen that is different than the tumor antigen that binds to the extracellular binding domain of the second AND-gate CAR polypeptide. In some embodiments of any of the aspects, the extracellular binding domain of the first AND-gate CAR polypeptide binds to a tumor antigen that is different than but found in close proximity to (e.g., on the same tumor cell) the tumor antigen that binds to the extracellular binding domain of the second AND-gate CAR polypeptide. In some embodiments of any of the aspects, the AND-gate system is not functional (e.g., result in intracellular signaling) unless both antigens of the first and second AND-gate CAR polypeptides are present in close proximity (e.g., on the same tumor cell).

In some embodiments of any of the aspects, the first polypeptide and second polypeptide (e.g., of the AND-gate system) in the same contiguous molecule. In some embodiments of any of the aspects, the first polypeptide (e.g., of the AND-gate system) is N-terminal of the second polypeptide. In some embodiments of any of the aspects, the second polypeptide (e.g., of the AND-gate system) is N-terminal of the first polypeptide.

In some embodiments of any of the aspects, the first polypeptide and second polypeptide (e.g., of the AND-gate system) flank a self-cleaving peptide domain. In some embodiments of any of the aspects, the self-cleaving peptide is T2A, P2A, or another self-cleaving peptide as described herein. The self-cleaving peptide allows the nucleic acids of the first polypeptide and second polypeptide (e.g., of the AND-gate system) to be present in the same vector, but after translation the self-cleaving peptide cleaves the translated polypeptide into two separate polypeptides.

In several aspects, described herein are drug-repressible (i.e., OFF-switch) CAR systems comprising two polypeptide components. A first polypeptide comprises a repressible protease, and a second polypeptide comprises a peptide domain that specifically binds to the repressible protease, such that in the absence of protease inhibitor specific for the repressible protease the two polypeptides of the OFF-switch CAR system are recruited together by the protease binding to the peptide. One or both of the polypeptides of the OFF-switch CAR system comprises an extracellular binding domain (e.g., specific for a tumor antigen), and one or both of the polypeptides comprise at least one intracellular signaling domain such that when the two polypeptides are brought into close proximity, binding of the cognate antigen to the extracellular binding domain results in intracellular signaling of the OFF-switch CAR system. In the presence of protease inhibitor, the two polypeptides of the OFF-switch CAR system are not brought together, and no intracellular signaling occurs, even in the presence of the cognate antigen. Thus, this drug-repressible system can be turned off in the presence of the protease inhibitor.

In one aspect described herein is a first polypeptide of an OFF-switch CAR system, comprising: (a) an extracellular binding domain; (b) a transmembrane domain; and (c) a peptide domain. In some embodiments of any of the aspects, the extracellular binding domain (e.g., of the first polypeptide of an OFF-switch CAR system) is N-terminal to the transmembrane domain, and the transmembrane domain to N-terminal to the intracellular domains (e.g., peptide domain and any other intracellular domains if present). In some embodiments of any of the aspects, the first polypeptide of an OFF-switch CAR system further comprises at least one intracellular signaling domain as described further herein. In some embodiments of any of the aspects, the at least one intracellular signaling domain (e.g., of the first polypeptide of an OFF-switch CAR system) is N-terminal to the peptide domain. In some embodiments of any of the aspects, the peptide domain (e.g., of the first polypeptide of an OFF-switch CAR system) is N-terminal to the at least one intracellular signaling domain. In some embodiments of any of the aspects, the peptide domain (e.g., of the first polypeptide of an OFF-switch CAR system) is N-terminal to at least one intracellular signaling domain and C-terminal to at least one intracellular signaling domain.

In some embodiments of any of the aspects, the peptide domain is specifically bound by a repressible protease. In some embodiments of any of the aspects, the peptide domain is specifically bound by NS3. In some embodiments of any of the aspects, the peptide domain is specifically bound by NS3 genotype 1B (e.g., SEQ ID NO: 75, 99). In some embodiments of any of the aspects, the peptide domain is specifically bound by any repressible protease as described herein. In some embodiments of any of the aspects, the first OFF-switch CAR polypeptide does not comprise any protease cleavage sites for the repressible protease.

In some embodiments of any of the aspects, the peptide domain of the first OFF-switch CAR polypeptide as described herein is specifically bound by a repressible protease comprising SEQ ID NO: 99, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 99 that maintains the same function. In some embodiments of any of the aspects, the peptide domain of the first OFF-switch CAR polypeptide as described herein is specifically bound by a repressible protease comprising SEQ ID NO: 99, or an amino acid sequence that is at least 95% identical to the sequence of SEQ ID NO: 99 that maintains the same function.

In some embodiments of any of the aspects, the peptide domain of the first OFF-switch CAR polypeptide as described herein is specifically bound by a repressible protease encoded by a nucleic acid sequence comprising SEQ ID NO: 75, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 75 that maintains the same function or a codon-optimized version of SEQ ID NO: 75. In some embodiments of any of the aspects, the peptide domain of the first OFF-switch CAR polypeptide as described herein is specifically bound by a repressible protease encoded by a nucleic acid sequence comprising SEQ ID NO: 75, or a sequence that is at least 95% identical to SEQ ID NO: 75 that maintains the same function.

In some embodiments of any of the aspects, the peptide domain comprises any peptide domain as described herein. In some embodiments of any of the aspects, the first polypeptide (e.g., of the OFF-switch CAR system) comprises 1, 2, 3, 4, or at least 5 peptide domains. In some embodiments of any of the aspects, the first OFF-switch CAR polypeptide comprises one peptide domain. In embodiments comprising multiple peptide domains, the multiple peptide domains can be different individual peptide domains or multiple copies of the same peptide domain, or a combination of the foregoing.

In some embodiments of any of the aspects, the peptide domain of the first OFF-switch CAR polypeptide as described herein comprises SEQ ID NO: 95, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 95 that maintains the same function. In some embodiments of any of the aspects, the peptide domain of the first OFF-switch CAR polypeptide as described herein comprises SEQ ID NO: 95, or an amino acid sequence that is at least 95% identical to the sequence of SEQ ID NO: 95 that maintains the same function.

In some embodiments of any of the aspects, the peptide domain of the first OFF-switch CAR polypeptide as described herein is encoded by a nucleic acid sequence comprising SEQ ID NO: 71, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 71 that maintains the same function or a codon-optimized version of SEQ ID NO: 71. In some embodiments of any of the aspects, the peptide domain of the first OFF-switch CAR polypeptide as described herein is encoded by a nucleic acid sequence comprising SEQ ID NO: 71, or a sequence that is at least 95% identical to SEQ ID NO: 71 that maintains the same function.

In some embodiments of any of the aspects, the first polypeptide (e.g., of the OFF-switch CAR system) is referred to as "component a." In some embodiments of any of the aspects, the component a polypeptide comprises from the N-terminus to the C-terminus: (a) an extracellular binding domain (e.g., SEQ ID NO: 70, 94); (b) a transmembrane domain (e.g., SEQ ID NO: 11, 44); and (c) a peptide domain (e.g., SEQ ID NO: 71, 95). In some embodiments of any of the aspects, the first polypeptide (e.g., component a of the OFF-switch CAR system) does not comprise an intracellular signaling domain.

In some embodiments of any of the aspects, the component a polypeptide (e.g., of the OFF-switch CAR system) as described herein comprises SEQ ID NOs: 94, 44, and 95, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to a sequence comprising SEQ ID NOs: 94, 44, and 95 that maintains the same functions as SEQ ID NOs: 94, 44, and 95. In some embodiments of any of the aspects, the component a polypeptide (e.g., of the OFF-switch CAR system) as described herein comprises SEQ ID NOs: 94, 44, and 95, or an amino acid sequence that is at least 95% identical to a sequence comprising SEQ ID NOs: 94, 44, and 95 that maintains the same functions as SEQ ID NOs: 94, 44, and 95.

In some embodiments of any of the aspects, the component a polypeptide (e.g., of the OFF-switch CAR system) as described herein is encoded by a nucleic acid sequence comprising SEQ ID NOs: 70, 11, and 71, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to a sequence comprising SEQ ID NOs: 70, 11, and 71 that maintains the same function or a codon-optimized version thereof. In some embodiments of any of the aspects, the component a polypeptide (e.g., of the OFF-switch CAR system) as described herein is encoded by a nucleic acid sequence comprising SEQ ID NOs: 70, 11, and 71, or a sequence that is at least 95% identical to a sequence comprising SEQ ID NOs: 70, 11, and 71 that maintains the same function.

In some embodiments of any of the aspects, the first polypeptide (e.g., of the OFF-switch CAR system) is referred to as "component b", "component c" or "component d." In some embodiments of any of the aspects, the component b, c, or d polypeptide (e.g., of the OFF-switch CAR system) comprises from the N-terminus to the C-terminus: (a) an extracellular binding domain; (b) a transmembrane domain; (c) at least one intracellular signaling domain; and (d) a peptide domain. In some embodiments of any of the aspects, the component b or c polypeptide (e.g., of the OFF-switch CAR system) comprises from the N-terminus to the C-terminus: (a) an extracellular binding domain; (b) a transmembrane domain; (c) a single intracellular signaling domain; and (d) a peptide domain.

In some embodiments of any of the aspects, the component b polypeptide (e.g., of the OFF-switch CAR system) comprises the intracellular signaling domain of 4-1BB (e.g., SEQ ID NO: 20, 53) as the single intracellular signaling domain. In some embodiments of any of the aspects, the component b polypeptide (e.g., of the OFF-switch CAR system) comprises from the N-terminus to the C-terminus: (a) an extracellular binding domain (e.g., SEQ ID NO: 70, 94); (b) a transmembrane domain (e.g., SEQ ID NO: 11, 44); (c) a 4-1BB intracellular signaling domain (e.g., SEQ ID NO: 20, 53); and (d) a peptide domain (e.g., SEQ ID NO: 71, 95).

In some embodiments of any of the aspects, the component b polypeptide (e.g., of the OFF-switch CAR system) as described herein comprises SEQ ID NOs: 94, 44, 53, and 95, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to a sequence comprising SEQ ID NOs: 94, 44, 53, and 95 that maintains the same functions as SEQ ID NOs: 94, 44, 53, and 95. In some embodiments of any of the aspects, the component b polypeptide (e.g., of the OFF-switch CAR system) as described herein comprises SEQ ID NOs: 94, 44, 53, and 95, or an amino acid sequence that is at least 95% identical to a sequence comprising SEQ ID NOs: 94, 44, 53, and 95 that maintains the same functions as SEQ ID NOs: 94, 44, 53, and 95.

In some embodiments of any of the aspects, the component b polypeptide (e.g., of the OFF-switch CAR system) as described herein is encoded by a nucleic acid sequence comprising SEQ ID NOs: 70, 11, 20, and 71, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to a sequence comprising SEQ ID NOs: 70, 11, 20, and 71 that maintains the same function or a codon-optimized version thereof. In some embodiments of any of the aspects, the component b polypeptide (e.g., of the OFF-switch CAR system) as described herein is encoded by a nucleic acid sequence comprising SEQ ID NOs: 70, 11, 20, and 71, or a sequence that is at least 95% identical to a sequence comprising SEQ ID NOs: 70, 11, 20, and 71 that maintains the same function.

In some embodiments of any of the aspects, the component c polypeptide (e.g., of the OFF-switch CAR system) comprises the intracellular signaling domain of CD28 as the single intracellular signaling domain. In some embodiments of any of the aspects, the component c polypeptide (e.g., of the OFF-switch CAR system) comprises from the N-terminus to the C-terminus: (a) an extracellular binding domain; (b) a transmembrane domain; (c) a CD28 intracellular signaling domain; and (d) a peptide domain.

In some embodiments of any of the aspects, the component c polypeptide (e.g., of the OFF-switch CAR system) comprises SEQ ID NO: 84 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 84 that maintains the same functions as SEQ ID NO: 84 (e.g., target cell binding, peptide domain, etc.). In some embodiments of any of the aspects, the component c polypeptide (e.g., of the OFF-switch CAR system) comprises SEQ ID NO: 84 or an amino acid sequence that is at least 95% identical to the sequence of SEQ ID NO: 84 that maintains the same function.

In some embodiments of any of the aspects, the component c polypeptide (e.g., of the OFF-switch CAR system) is encoded by a nucleic acid sequence comprising SEQ ID NO: 60 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 60 that maintains the same function or a codon-optimized version of SEQ ID NO: 60. In some embodiments of any of the aspects, the component c polypeptide (e.g., of the OFF-switch CAR system) is encoded by a nucleic acid sequence comprising SEQ ID NO: 60 or a sequence that is at least 95% identical to SEQ ID NO: 60 that maintains the same function.

In some embodiments of any of the aspects, the component d polypeptide (e.g., of the OFF-switch CAR system) comprises from the N-terminus to the C-terminus: (a) an extracellular binding domain; (b) a transmembrane domain; (c) a first intracellular signaling domain; (d) a second intracellular signaling domain; and (e) a peptide domain. In some embodiments of any of the aspects, the first (or second) intracellular signaling domain of the component d polypeptide (e.g., of the OFF-switch CAR system) comprises the intracellular signaling domain of CD28. In some embodiments of any of the aspects, the second (or first) intracellular signaling domain of the component d polypeptide (e.g., of the OFF-switch CAR system) comprises the intracellular signaling domain of 4-1BB.

In some embodiments of any of the aspects, the component d polypeptide (e.g., of the OFF-switch CAR system) comprises SEQ ID NO: 85 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 85 that maintains the same functions as SEQ ID NO: 85 (e.g., target cell binding, peptide domain, etc.). In some embodiments of any of the aspects, the component d polypeptide (e.g., of the OFF-switch CAR system) comprises SEQ ID NO: 85 or an amino acid sequence that is at least 95% identical to the sequence of SEQ ID NO: 85 that maintains the same function.

In some embodiments of any of the aspects, the component d polypeptide (e.g., of the OFF-switch CAR system) is encoded by a nucleic acid sequence comprising SEQ ID NO: 61 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 61 that maintains the same function or a codon-optimized version of SEQ ID NO: 61. In some embodiments of any of the aspects, the component d polypeptide (e.g., of the OFF-switch CAR system) is encoded by a nucleic acid sequence comprising SEQ ID NO: 61 or a sequence that is at least 95% identical to SEQ ID NO: 61 that maintains the same function.

In some embodiments of any of the aspects, the extracellular binding domain of the first OFF-switch CAR polypeptide is an antibody, an antigen-binding fragment thereof, a F(ab) fragment, a F(ab') fragment, a single chain variable fragment (scFv), or a single-domain antibody (sdAb). In some embodiments of any of the aspects, the extracellular binding domain of the first OFF-switch CAR polypeptide comprises a scFv. In some embodiments of any of the aspects, the extracellular binding domain of the first OFF-switch CAR polypeptide binds to a tumor antigen, as described further herein. In some embodiments of any of the aspects, the first OFF-switch CAR polypeptide comprises a leading peptide located N-terminal to the extracellular binding domain. In some embodiments of any of the aspects, the leading peptide is CD8alpha leading peptide or another leading peptide as described herein.

In some embodiments of any of the aspects, the transmembrane domain is located between the extracellular binding domain and the at least one intracellular signaling domain. The transmembrane domain of the first OFF-switch CAR polypeptide can be any known transmembrane domain. In one embodiment, the transmembrane domain of the first OFF-switch CAR polypeptide comprises the transmembrane domain of CD28. In some embodiments of any of the aspects, the first OFF-switch CAR polypeptide comprises a spacer domain located between the extracellular binding domain and the transmembrane domain. In some embodiments of any of the aspects, the spacer domain comprises a CD8a hinge domain or another spacer domain as described herein.

In some embodiments of any of the aspects, the first OFF-switch CAR polypeptide comprises 0, 1, 2, 3, 4, 5, or more intracellular signaling domains. In embodiments comprising multiple intracellular signaling domains, the multiple repressible proteases can be different individual intracellular signaling domains or multiple copies of the same intracellular signaling domain, or a combination of the foregoing. In some embodiments of any of the aspects, the intracellular signaling domain (e.g., of the first OFF-switch CAR polypeptide), if it is present, comprises at least one intracellular signaling domain selected from the group consisting of: TCRC; FcRy; FcRp; CD3zeta; CD3y; CD35; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-L1); CD278 (ICOS); DAP10; LAT; KD2C SLP76; TRIM; ZAP70; and 41BB. In some embodiments of any of the aspects, the first OFF-switch CAR polypeptide comprises the intracellular signaling domain of CD28 and/or 4-1BB.

In some embodiments of any of the aspects, the first OFF-switch CAR polypeptide comprises at least one detectable marker as described herein. As a non-limiting example, the at least one detectable marker can be used to detect the expression of the first OFF-switch CAR polypeptide. In some embodiments of any of the aspects, the first OFF-switch CAR polypeptide comprises a detectable marker adjacent to and C terminal of the extracellular binding domain. As a non-limiting example, the detectable marker(s) can be selected from GFP, V5, HA1, Myc, VSV-G, HSV, FLAG, HIS, mCherry, AU1, and biotin or another detectable marker as described herein (see e.g., Table 3).

In one aspect described herein is a second polypeptide of an OFF-switch CAR system, comprising: (a) an extracellular domain; (b) a transmembrane domain; (c) a repressible protease; and (d) at least one intracellular signaling domain. In some embodiments of any of the aspects, the extracellular domain (e.g., of the second polypeptide of an OFF-switch CAR system) is N-terminal to the transmembrane domain, and the transmembrane domain to N-terminal to the intracellular domains (e.g., repressible protease and at least one intracellular signaling domain). In some embodiments of any of the aspects, the at least one intracellular signaling domain (e.g., of the second polypeptide of an OFF-switch CAR system) is N-terminal to the repressible protease. In some embodiments of any of the aspects, the repressible protease (e.g., of the second polypeptide of an OFF-switch CAR system) is N-terminal to the at least one intracellular signaling domain. In some embodiments of any of the aspects, the repressible protease (e.g., of the second polypeptide of an OFF-switch CAR system) is N-terminal to at least one intracellular signaling domain and C-terminal to at least one intracellular signaling domain.

In one aspect described herein is a second polypeptide of an OFF-switch CAR system, comprising: (a) a repressible protease and (b) at least one intracellular signaling domain. In some embodiments of any of the aspects, the second polypeptide of an OFF-switch CAR system does not comprise an extracellular domain and/or a transmembrane; accordingly, the second polypeptide of an OFF-switch CAR system can be an intracellular protein, as opposed to a transmembrane protein.

In some embodiments of any of the aspects, the second OFF-switch CAR polypeptide comprises 1, 2, 3, 4, 5, or more repressible protease(s). In one embodiment, the second OFF-switch CAR polypeptide comprises one repressible protease. In embodiments comprising multiple repressible proteases, the multiple repressible proteases can be different individual repressible proteases or multiple copies of the same repressible protease, or a combination of the foregoing. In some embodiments of any of the aspects, the repressible protease (e.g., of the second OFF-switch CAR polypeptide) is hepatitis C virus (HCV) nonstructural protein 3 (NS3). In one embodiment, the repressible protease of the second OFF-switch CAR polypeptide comprises NS3 genotype 1B (e.g., SEQ ID NO: 75, 99).

In some embodiments of any of the aspects, the repressible protease of the second OFF-switch CAR polypeptide as described herein comprises SEQ ID NO: 99, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 99 that maintains the same function. In some embodiments of any of the aspects, the repressible protease of the second OFF-switch CAR polypeptide as described herein comprises SEQ ID NO: 99, or an amino acid sequence that is at least 95% identical to the sequence of SEQ ID NO: 99 that maintains the same function.

In some embodiments of any of the aspects, the repressible protease of the second OFF-switch CAR polypeptide as described herein is encoded by a nucleic acid sequence comprising SEQ ID NO: 75, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 75 that maintains the same function or a codon-optimized version of SEQ ID NO: 75. In some embodiments of any of the aspects, the repressible protease of the second OFF-switch CAR polypeptide as described herein is encoded by a nucleic acid sequence comprising SEQ ID NO: 75, or a sequence that is at least 95% identical to SEQ ID NO: 75 that maintains the same function.

In some embodiments of any of the aspects, the repressible protease of the second OFF-switch CAR polypeptide is catalytically inactive (i.e., dead). For NS3 genotype 1B, the catalytic triad comprises His-57, Asp-81, and Ser-139. Accordingly, a catalytically inactive NS3 protease can comprise a nonsynonymous mutation at any one of His-57, Asp-8 1, and Ser-139, or another inactivating mutation as described herein. In some embodiments of any of the aspects, the N33 protease (e.g., of the second OFF-switch CAR polypeptide) comprises an S139A mutation. In regard to a repressible protease, "catalytically inactive" refers to the inability to cleave at a protease cleavage site. In some embodiments of any of the aspects, the catalytically inactive repressible protease retains the ability to specifically bind to the peptide domain of the first OFF-switch CAR polypeptide, but the catalytically inactive repressible protease does not cleave the peptide domain. In some embodiments of any of the aspects, the second OFF-switch CAR polypeptide does not comprise any protease cleavage sites. In some embodiments of any of the aspects, the repressible protease (e.g., of the second OFF-switch CAR polypeptide) can be any repressible protease as described further herein, e.g., that binds to the peptide domain of the first OFF-switch CAR polypeptide.

In some embodiments of any of the aspects, the repressible protease (e.g., of the second OFF-switch CAR polypeptide) is located: (a) between the transmembrane domain and the at least one intracellular signaling domain; (b) between the first intracellular signaling domain and the second intracellular signaling domain; or (c) at the C terminus of the polypeptide. In some embodiments of any of the aspects, the repressible protease (e.g., of the second OFF-switch CAR polypeptide) is located: (a) between the transmembrane domain and the at least one intracellular signaling domain. In some embodiments of any of the aspects, the repressible protease (e.g., of the second OFF-switch CAR polypeptide) is located: (b) between the first intracellular signaling domain and the second intracellular signaling domain. In some embodiments of any of the aspects, the repressible protease (e.g., of the second OFF-switch CAR polypeptide) is located: (c) at the C terminus of the polypeptide.

In some embodiments of any of the aspects, the repressible protease (e.g., of the second OFF-switch CAR polypeptide) is located: (a) between the transmembrane domain and the at least one intracellular signaling domain; and (b) between the first intracellular signaling domain and the second intracellular signaling domain. In some embodiments of any of the aspects, the repressible protease (e.g., of the second OFF-switch CAR polypeptide) is located: (a) between the transmembrane domain and the at least one intracellular signaling domain; and (c) at the C terminus of the polypeptide. In some embodiments of any of the aspects, the repressible protease (e.g., of the second OFF-switch CAR polypeptide) is located: (b) between the first intracellular signaling domain and the second intracellular signaling domain; and (c) at the C terminus of the polypeptide. In some embodiments of any of the aspects, the repressible protease (e.g., of the second OFF-switch CAR polypeptide) is located: (a) between the transmembrane domain and the at least one intracellular signaling domain; (b) between the first intracellular signaling domain and the second intracellular signaling domain; and (c) at the C terminus of the polypeptide.

In some embodiments of any of the aspects, the second OFF-switch CAR polypeptide is in combination with a protease inhibitor bound to the repressible protease. In some embodiments of any of the aspects, the second OFF-switch CAR polypeptide is bound to a protease inhibitor bound to the repressible protease. In some embodiments of any of the aspects, the second OFF-switch CAR polypeptide is bound specifically to a protease inhibitor bound to the repressible protease. Non-limiting examples of protease inhibitors (e.g., for NS3) include grazoprevir (GZV), danoprevir, simeprevir, asunaprevir, ciluprevir, boceprevir, sovaprevir, paritaprevir, ombitasvir, paritaprevir, ritonavir, dasabuvir, and telaprevir; further examples are described herein. In some embodiments of any of the aspects, the second OFF-switch CAR polypeptide does not bind to the first OFF-switch CAR polypeptide when the protease inhibitor is bound to the repressible protease of the second OFF-switch CAR polypeptide.

In some embodiments of any of the aspects, the second OFF-switch CAR polypeptide further comprises a cofactor for the repressible protease. In some embodiments of any of the aspects, the cofactor (e.g., for NS3) is an HSV NS4A domain, as described further herein. In one embodiment, the second OFF-switch CAR polypeptide comprises genotype 1B NS4A (e.g., SEQ ID NO: 74, 98). In some embodiments of any of the aspects, the HSV NS4A domain is adjacent and N-terminal to the repressible protease (e.g., NS3).

In some embodiments of any of the aspects, the cofactor for the repressible protease of the second OFF-switch CAR polypeptide as described herein comprises SEQ ID NO: 98, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 98 that maintains the same function. In some embodiments of any of the aspects, the cofactor for the repressible protease of the second OFF-switch CAR polypeptide as described herein comprises SEQ ID NO: 98, or an amino acid sequence that is at least 95% identical to the sequence of SEQ ID NO: 98 that maintains the same function.

In some embodiments of any of the aspects, the cofactor for the repressible protease of the second OFF-switch CAR polypeptide as described herein is encoded by a nucleic acid sequence comprising SEQ ID NO: 74, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 74 that maintains the same function or a codon-optimized version of SEQ ID NO: 74. In some embodiments of any of the aspects, the cofactor for the repressible protease of the second OFF-switch CAR polypeptide as described herein is encoded by a nucleic acid sequence comprising SEQ ID NO: 74, or a sequence that is at least 95% identical to SEQ ID NO: 74 that maintains the same function.

In some embodiments of any of the aspects, the second polypeptide (e.g., of the OFF-switch CAR system) is referred to as "component i." In some embodiments of any of the aspects, the component i polypeptide (e.g., of the OFF-switch CAR system) comprises from the N-terminus to the C-terminus: (a) an extracellular domain; (b) a transmembrane domain; (c) at least one intracellular signaling domain; (d) a repressible protease; and (e) at least one intracellular signaling domain. In some embodiments of any of the aspects, the component i polypeptide (e.g., of the OFF-switch CAR system) comprises from the N-terminus to the C-terminus: (a) an extracellular domain; (b) a transmembrane domain; (c) a first intracellular signaling domain; (d) a repressible protease; and (e) a second intracellular signaling domain. In some embodiments of any of the aspects, the first intracellular signalling domain of component i (e.g., of the second OFF-switch CAR polypeptide) comprises the intracellular signaling domain of 4-1BB. In some embodiments of any of the aspects, the second intracellular signalling domain of component i (e.g., of the second OFF-switch CAR polypeptide) comprises the intracellular signaling domain of CD3zeta.

In some embodiments of any of the aspects, the component i polypeptide (e.g., of the OFF-switch CAR system) comprises SEQ ID NO: 86 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 86 that maintains the same functions as SEQ ID NO: 86 (e.g., CD3zeta signaling, etc.). In some embodiments of any of the aspects, the component i polypeptide (e.g., of the OFF-switch CAR system) comprises SEQ ID NO: 86 or an amino acid sequence that is at least 95% identical to the sequence of SEQ ID NO: 86 that maintains the same function.

In some embodiments of any of the aspects, the component i polypeptide (e.g., of the OFF-switch CAR system) is encoded by a nucleic acid sequence comprising SEQ ID NO: 62 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 62 that maintains the same function or a codon-optimized version of SEQ ID NO: 62. In some embodiments of any of the aspects, the component i polypeptide (e.g., of the OFF-switch CAR system) is encoded by a nucleic acid sequence comprising SEQ ID NO: 62 or a sequence that is at least 95% identical to SEQ ID NO: 62 that maintains the same function.

In some embodiments of any of the aspects, the second polypeptide (e.g., of the OFF-switch CAR system) is referred to as "component ii" or "component iv." In some embodiments of any of the aspects, the component ii or component iv polypeptide (e.g., of the OFF-switch CAR system) comprises from the N-terminus to the C-terminus: (a) an extracellular domain; (b) a transmembrane domain; (c) at least one intracellular signaling domain; and (d) a repressible protease. In some embodiments of any of the aspects, the component ii polypeptide (e.g., of the OFF-switch CAR system) comprises from the N-terminus to the C-terminus: (a) an extracellular domain; (b) a transmembrane domain; (c) a first intracellular signaling domain; (d) a second intracellular signaling domain; and (e) a repressible protease. In some embodiments of any of the aspects, the first intracellular signalling domain of component ii (e.g., of the second OFF-switch CAR polypeptide) comprises the intracellular signaling domain of 4-1BB. In some embodiments of any of the aspects, the second intracellular signalling domain of component ii (e.g., of the second OFF-switch CAR polypeptide) comprises the intracellular signaling domain of CD3zeta.

In some embodiments of any of the aspects, the component ii polypeptide (e.g., of the OFF-switch CAR system) comprises SEQ ID NO: 87 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 87 that maintains the same functions as SEQ ID NO: 87 (e.g., CD3zeta signaling, etc.). In some embodiments of any of the aspects, the component ii polypeptide (e.g., of the OFF-switch CAR system) comprises SEQ ID NO: 87 or an amino acid sequence that is at least 95% identical to the sequence of SEQ ID NO: 87 that maintains the same function.

In some embodiments of any of the aspects, the component ii polypeptide (e.g., of the OFF-switch CAR system) is encoded by a nucleic acid sequence comprising SEQ ID NO: 63 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 63 that maintains the same function or a codon-optimized version of SEQ ID NO: 63. In some embodiments of any of the aspects, the component ii polypeptide (e.g., of the OFF-switch CAR system) is encoded by a nucleic acid sequence comprising SEQ ID NO: 63 or a sequence that is at least 95% identical to SEQ ID NO: 63 that maintains the same function.

In some embodiments of any of the aspects, the second polypeptide (e.g., of the OFF-switch CAR system) is referred to as "component iii." In some embodiments of any of the aspects, the component iii polypeptide (e.g., of the OFF-switch CAR system) comprises from the N-terminus to the C-terminus: (a) an extracellular domain; (b) a transmembrane domain; (c) a repressible protease; and (d) at least one intracellular signaling domain. In some embodiments of any of the aspects, the component iii polypeptide (e.g., of the OFF-switch CAR system) comprises from the N-terminus to the C-terminus: (a) an extracellular domain; (b) a transmembrane domain; (c) a repressible protease; and (d) a single intracellular signaling domain. In some embodiments of any of the aspects, the single intracellular signalling domain of component iii (e.g., of the second OFF-switch CAR polypeptide) comprises the intracellular signaling domain of CD3zeta.

In some embodiments of any of the aspects, the component iii polypeptide (e.g., of the OFF-switch CAR system) comprises SEQ ID NO: 88 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 88 that maintains the same functions as SEQ ID NO: 88 (e.g., CD3zeta signaling, etc.). In some embodiments of any of the aspects, the component iii polypeptide (e.g., of the OFF-switch CAR system) comprises SEQ ID NO: 88 or an amino acid sequence that is at least 95% identical to the sequence of SEQ ID NO: 88 that maintains the same function.

In some embodiments of any of the aspects, the component iii polypeptide (e.g., of the OFF-switch CAR system) is encoded by a nucleic acid sequence comprising SEQ ID NO: 64 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 64 that maintains the same function or a codon-optimized version of SEQ ID NO: 64. In some embodiments of any of the aspects, the component iii polypeptide (e.g., of the OFF-switch CAR system) is encoded by a nucleic acid sequence comprising SEQ ID NO: 64 or a sequence that is at least 95% identical to SEQ ID NO: 64 that maintains the same function.

In some embodiments of any of the aspects, the component iv polypeptide (e.g., of the OFF-switch CAR system) comprises from the N-terminus to the C-terminus: (a) an extracellular domain; (b) a transmembrane domain; (c) a single intracellular signaling domain; and (d) a repressible protease. In some embodiments of any of the aspects, the single intracellular signalling domain of component iv (e.g., of the second OFF-switch CAR polypeptide) comprises the intracellular signaling domain of CD3zeta.

In some embodiments of any of the aspects, the component iv polypeptide (e.g., of the OFF-switch CAR system) comprises SEQ ID NO: 89 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 89 that maintains the same functions as SEQ ID NO: 89 (e.g., CD3zeta signaling, etc.). In some embodiments of any of the aspects, the component iv polypeptide (e.g., of the OFF-switch CAR system) comprises SEQ ID NO: 89 or an amino acid sequence that is at least 95% identical to the sequence of SEQ ID NO: 89 that maintains the same function.

In some embodiments of any of the aspects, the component iv polypeptide (e.g., of the OFF-switch CAR system) is encoded by a nucleic acid sequence comprising SEQ ID NO: 65 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 65 that maintains the same function or a codon-optimized version of SEQ ID NO: 65. In some embodiments of any of the aspects, the component iv polypeptide (e.g., of the OFF-switch CAR system) is encoded by a nucleic acid sequence comprising SEQ ID NO: 65 or a sequence that is at least 95% identical to SEQ ID NO: 65 that maintains the same function or a codon-optimized version of SEQ ID NO: 65.

In some embodiments of any of the aspects, the extracellular domain (e.g., of the second OFF-switch CAR system polypeptide) comprises the extracellular domain of DAP10. In some embodiments of any of the aspects, the extracellular domain (e.g., of the second OFF-switch CAR system polypeptide) is another extracellular domain as described herein. In some embodiments of any of the aspects, the second OFF-switch CAR system polypeptide does not comprise an extracellular binding domain.

In some embodiments of any of the aspects, the transmembrane domain is located between the extracellular domain and the at least one intracellular signaling domain. The transmembrane domain of the second OFF-switch CAR polypeptide can be any known transmembrane domain. In one embodiment, the transmembrane domain of the second OFF-switch CAR polypeptide comprises the transmembrane domain of CD8.

In some embodiments of any of the aspects, the second OFF-switch CAR polypeptide comprises 1, 2, 3, 4, 5, or more intracellular signaling domains. In some embodiments of any of the aspects, the intracellular signaling domain (e.g., of the second OFF-switch CAR polypeptide) comprises at least one intracellular signaling domain selected from the group consisting of: TCRC; FcRy; FcRp; CD3zeta; CD3y; CD3S; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-L1); CD278 (ICOS); DAP10; LAT; KD2C SLP76; TRIM; ZAP70; and 41BB. In some embodiments of any of the aspects, the second OFF-switch CAR polypeptide comprises the intracellular signaling domain of 4-1BB and/or CD3zeta.

In some embodiments of any of the aspects, the second OFF-switch CAR polypeptide further comprises at least one detectable marker as described further herein. In some embodiments of any of the aspects, the detectable marker (e.g., of the second OFF-switch CAR polypeptide) is located at the C-terminal end of the polypeptide. In some embodiments of any of the aspects, the detectable marker (e.g., of the second OFF-switch CAR polypeptide) is selected from GFP, V5, HA1, Myc, VSV-G, HSV, FLAG, HIS, AU1, mCherry, and biotin.

Tables 3 and 4 shows the locations of specific domains in exemplary two-component OFF-Switch CAR sequences. Table 3 shows the first component, and Table 4 shows the second component. The nucleic acid numbers are shown first, followed by the amino acid residues.

TABLE 3

OFF-Switch CAR Sequences, First Component

| Element (SEQ ID NOs) | Component c (SEQ ID NO: 60, 84) | Component d (SEQ ID NO: 61, 85) |
|---|---|---|
| CD8a leading peptide (7, 40) | 1-63, 1-20 | 1-63, 1-20 |
| CD19 scFv (70, 94) | 64-789, 21-262 | 64-789, 21-262 |
| V5 tag (9, 42) | 790-831, 263-276 | 790-831, 263-276 |
| CD8 hinge (10, 43) | 844-978, 281-325 | 844-978, 281-325 |
| CD28 transmembrane (11, 44) | 979-1059, 326-352 | 979-1059, 326-352 |
| CD28 ICD (19, 52) | 1060-1182, 353-393 | 1060-1182, 353-393 |
| 41BB ICD (20, 53) | | 1183-1308, 394-435 |
| CP5-46-5D5E (71, 95) | 1228-1326, 409-441 | 1354-1452, 451-483 |

TABLE 4

OFF-Switch CAR Sequences, Second Component

| Element (SEQ ID NOs) | Component i (SEQ ID NO: 62, 86) | Component ii (SEQ ID NO: 63, 87) | Component iii (SEQ ID NO: 64, 88) | Component iv (SEQ ID NO: 65, 89) |
|---|---|---|---|---|
| DAP10 ectodomain (72, 96) | 1-144, 1-47 | 1-144, 1-47 | 1-144, 1-47 | 1-144, 1-47 |
| CD8 transmembrane (73, 97) | 145-207, 48-68 | 145-207, 48-68 | 145-207, 48-68 | 145-207, 48-68 |

TABLE 4-continued

OFF-Switch CAR Sequences, Second Component

| Element (SEQ ID NOs) | Component i (SEQ ID NO: 62, 86) | Component ii (SEQ ID NO: 63, 87) | Component iii (SEQ ID NO: 64, 88) | Component iv (SEQ ID NO: 65, 89) |
|---|---|---|---|---|
| 41BB ICD (20, 53) | 208-333, 69-110 | 208-333, 69-110 | | |
| NS4A (74, 98) | 334-369, 111-122 | 670-705, 223-234 | 208-243, 69-80 | 544-579, 181-192 |
| NS3 (75, 99) | 382-918, 127-305 | 718-1254, 239-417 | 256-792, 85-263 | 592-1128, 197-375 |
| CD3z ICD (21, 54) | 919-1254, 306-417 | 334-669, 111-222 | 793-1128, 264-375 | 208-543, 69-180 |
| mCherry (76, 100) | 1258-1968, 419-654 | 1258-1968, 419-654 | 1132-1842, 377-612 | 1132-1842, 377-612 |

In one aspect, described herein is an OFF-switch CAR system comprising the first and second OFF-switch polypeptides as described herein. Accordingly, the OFF-switch CAR system comprises: (a) a first polypeptide comprising: (i) an extracellular binding domain; (ii) a transmembrane domain; and (iii) a peptide domain; and (b) a second polypeptide comprising: (i) an extracellular domain; (ii) a transmembrane domain; (iii) a repressible protease; and (iv) at least one intracellular signaling domain. In some embodiments of any of the aspects, the second polypeptide (e.g., of the OFF-switch CAR system) specifically binds to the first polypeptide (e.g., of the OFF-switch CAR system); see e.g., Tables 7 and 8. In some embodiments of any of the aspects, the second polypeptide (e.g., of the OFF-switch CAR system) specifically binds to the first polypeptide (e.g., of the OFF-switch CAR system) in the absence of a protease inhibitor. In some embodiments of any of the aspects, the OFF-switch CAR system is active (e.g., results in intracellular signaling when the extracellular binding domain binds its specific antigen) in the absence of the protease inhibitor.

In some embodiments of any of the aspects, the OFF-switch CAR system is in combination with a protease inhibitor bound to the repressible protease of the second polypeptide. In some embodiments of any of the aspects, the second OFF-switch CAR polypeptide is bound to a protease inhibitor bound to the repressible protease. In some embodiments of any of the aspects, the second OFF-switch CAR polypeptide is bound specifically to a protease inhibitor bound to the repressible protease. In some embodiments of any of the aspects, the protease inhibitor is selected from grazoprevir (GZV), danoprevir, simeprevir, asunaprevir, ciluprevir, boceprevir, sovaprevir, paritaprevir, ombitasvir, paritaprevir, ritonavir, dasabuvir, telaprevir, or another protease inhibitor as described herein.

In some embodiments of any of the aspects, the second polypeptide (e.g., of the OFF-switch CAR system) does not specifically bind the first polypeptide (e.g., of the OFF-switch CAR system) in the presence of the protease inhibitor. In some embodiments of any of the aspects, the OFF-switch CAR system is inactive (e.g., does not result in intracellular signaling) in the presence of the protease inhibitor.

In some embodiments of any of the aspects, one polypeptide of the OFF-switch CAR system comprises a peptide domain, and the other polypeptide of the OFF-switch CAR system comprises a repressible protease that binds to the peptide domain. In some embodiments of any of the aspects, one polypeptide of the OFF-switch CAR system comprises an intracellular signaling domain, and the other polypeptide of the OFF-switch CAR system comprises an intracellular signaling domain that is a co-stimulatory domain. In some embodiments of any of the aspects, one polypeptide of the OFF-switch CAR system comprises an extracellular binding domain, and the other polypeptide of the OFF-switch CAR system comprises an extracellular domain (e.g., extracellular domain of DAP10) but does not comprise an extracellular binding domain. The OFF-switch CAR system can comprise any combination and assortment of peptide domain, repressible protease, extracellular domain, signaling domain, and co-stimulatory domain between the two polypeptides (see e.g., Table 10 for non-limiting examples).

In some embodiments of any of the aspects, the first polypeptide (e.g., of the OFF-switch CAR system) comprises a co-stimulatory signaling domain. In some embodiments of any of the aspects, the co-stimulatory signaling domain of the first polypeptide (e.g., of the OFF-switch CAR system) comprises the co-stimulatory signaling domain of CD28. In some embodiments of any of the aspects, the co-stimulatory signaling domain of the first polypeptide (e.g., of the OFF-switch CAR system) comprises the co-stimulatory signaling domain of 4-1BB.

In some embodiments of any of the aspects, the second polypeptide (e.g., of the OFF-switch CAR system) comprises a signaling domain. In some embodiments of any of the aspects, the co-stimulatory signaling domain of the second polypeptide (e.g., of the OFF-switch CAR system) comprises the signaling domain of CD3zeta. In some embodiments of any of the aspects, the second polypeptide (e.g., of the OFF-switch CAR system) further comprises a co-stimulatory signaling domain. In some embodiments of any of the aspects, the co-stimulatory signaling domain of the second polypeptide (e.g., of the OFF-switch CAR system) comprises the co-stimulatory signaling domain of 4-1BB.

In some embodiments of any of the aspects, both polypeptides of the OFF-switch CAR system comprise an extracellular binding domain. In some embodiments of any of the aspects, the extracellular binding domain of the first OFF-switch CAR polypeptide binds to a tumor antigen that is the same as the tumor antigen that binds to the extracellular binding domain of the second OFF-switch CAR polypeptide. In some embodiments of any of the aspects, the extracellular binding domain of the first OFF-switch CAR polypeptide binds to a tumor antigen that is different than the tumor antigen that binds to the extracellular binding domain of the second OFF-switch CAR polypeptide. In some embodiments of any of the aspects, the extracellular binding domain of the first OFF-switch CAR polypeptide binds to a tumor antigen that is different than but found in close proximity to (e.g., on the same tumor cell) the tumor antigen that binds to the extracellular binding domain of the second OFF-switch CAR polypeptide. In some embodiments of any of the aspects, the OFF-switch CAR system is not functional (e.g., result in intracellular signaling) unless both antigens of the first and second OFF-switch CAR polypeptides are present in close proximity (e.g., on the same tumor cell).

TABLE 10

Exemplary combinations of domains in the first (1$^{st}$) and second (2$^{nd}$) polypeptides of the OFF-switch CAR system.

| | EBD | Pep. | Pro. | CD3z | CD28 | 41BB |
|---|---|---|---|---|---|---|
| 1st | x | x | | | x | |
| 2nd | | | x | x | | |
| 1st | x | x | | | x | x |
| 2nd | | | x | x | | |
| 1st | x | x | | | x | |
| 2nd | | | x | x | | x |
| 1st | x | x | | | x | x |
| 2nd | | | x | x | | x |
| 1st | x | | | x | x | |
| 2nd | | x | | x | | |
| 1st | x | | | x | x | x |
| 2nd | | x | | x | | |
| 1st | x | | | x | x | |
| 2nd | | x | | x | | x |
| 1st | x | | | x | x | x |
| 2nd | | x | | x | | x |
| 1st | | x | | | x | |
| 2nd | x | | x | x | | |
| 1st | | x | | | x | x |
| 2nd | x | | x | x | | |
| 1st | | x | | | x | |
| 2nd | x | | x | x | | x |
| 1st | | x | | | x | x |
| 2nd | x | | x | x | | x |
| 1st | | | | x | x | |
| 2nd | x | x | | x | | |
| 1st | | | | x | x | x |
| 2nd | x | x | | x | | |
| 1st | | | | x | x | |
| 2nd | x | x | | x | | x |
| 1st | | | | x | x | x |
| 2nd | x | x | | x | | x |
| 1st | x | x | | | x | x |
| 2nd | x | | | x | x | |
| 1st | x | x | | | x | x |
| 2nd | x | x | | x | | |
| 1st | x | x | | x | x | |
| 2nd | x | x | | x | | |
| 1st | x | x | | x | | |
| 2nd | x | x | | x | x | |
| 1st | x | x | | x | x | x |
| 2nd | x | x | | x | | |
| 1st | x | x | | x | x | |
| 2nd | x | x | | x | x | x |
| 1st | x | | | x | x | |
| 2nd | | x | | | | x |
| 1st | x | x | | | | x |
| 2nd | | | x | x | x | |
| 1st | x | x | | x | x | x |
| 2nd | | | x | | | x |
| 1st | x | | | | | x |
| 2nd | | x | | x | x | |
| 1st | x | | | x | | x |
| 2nd | | x | | x | x | x |
| 1st | x | | | | | x |
| 2nd | | x | | | x | x |
| 1st | x | | | | | x |
| 2nd | | x | | x | x | x |
| 1st | x | | | x | x | |
| 2nd | | x | | | | x |

TABLE 10-continued

Exemplary combinations of domains in the first (1$^{st}$) and second (2$^{nd}$) polypeptides of the OFF-switch CAR system.

| | EBD | Pep. | Pro. | CD3z | CD28 | 41BB |
|---|---|---|---|---|---|---|
| 1st | | | | x | x | x |
| 2nd | x | x | | | | x |
| 1st | | | | x | | x |
| 2nd | x | x | | x | x | x |
| 1st | | | | x | x | x |
| 2nd | x | x | | | | x |
| 1st | x | x | | | | x |
| 2nd | x | | | x | x | |
| 1st | x | x | | x | x | |
| 2nd | x | | | x | | x |
| 1st | x | x | | | | x |
| 2nd | x | x | | x | x | x |
| 1st | x | x | | x | x | |
| 2nd | x | | | x | | x |
| 1st | x | | | x | | |
| 2nd | x | x | | x | x | |
| 1st | x | | | x | x | |
| 2nd | x | x | | | | x |
| 1st | x | | | x | | |
| 2nd | x | x | | x | x | x |
| 1st | x | x | | | | |
| 2nd | | | | x | x | |
| 1st | x | x | | | | |
| 2nd | | | | x | x | x |
| 1st | x | x | | | | |
| 2nd | | | | x | | x |
| 1st | x | | | | | |
| 2nd | | | | x | x | x |
| 1st | x | | | x | | |
| 2nd | | | | x | x | |
| 1st | x | | | | | |
| 2nd | | | | x | x | x |
| 1st | x | | | x | | |
| 2nd | | | | x | | x |
| 1st | x | | | x | | |
| 2nd | | | x | x | x | x |

"EBD" indicates extracellular binding domain; where an EBD is not indicated, then an extracellular domain (e.g., DAP10 extracellular domain) is present.
"Pep" indicates the peptide domain.
"Pro." indicates the repressible protease. The domains shown in Table 10 are not necessarily shown in sequential order. Each polypeptide in Table 10 further comprises a transmembrane domain.

In some embodiments of any of the aspects, the first polypeptide and second polypeptide (e.g., of the OFF-switch CAR system) are physically linked to one another; in other words, the first polypeptide and second polypeptide (e.g., of the OFF-switch CAR system) are in the same contiguous molecule. In some embodiments of any of the aspects, the first polypeptide (e.g., of the OFF-switch CAR system) is N-terminal of the second polypeptide. In some embodiments of any of the aspects, the second polypeptide (e.g., of the OFF-switch CAR system) is N-terminal of the first polypeptide.

In some embodiments of any of the aspects, the first polypeptide and second polypeptide (e.g., of the OFF-switch CAR system) flank a self-cleaving peptide domain. In some embodiments of any of the aspects, the self-cleaving peptide is T2A, P2A, or another self-cleaving peptide as described herein. The self-cleaving peptide allows the nucleic acids of the first polypeptide and second polypeptide (e.g., of the OFF-switch CAR system) to be present in the same vector, but after translation the self-cleaving peptide cleaves the translated polypeptide into two separate polypeptides.

In some embodiments of any of the aspects, the OFF-switch CAR system polypeptide comprises SEQ ID NOs: 114, 115, 116, 117, 118, 119, 120, or 121 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 114-121 that maintains the same functions as one of SEQ ID NOs: 114-121 (e.g., target cell binding, CD3zeta signaling, etc.). In some embodiments of any of the aspects, the OFF-switch CAR system polypeptide comprises SEQ ID NOs: 114, 115, 116, 117, 118, 119, 120, or 121 or an amino acid sequence that is at least 95% identical to the sequence of one of SEQ ID NOs: 114-121 that maintains the same function.

In some embodiments of any of the aspects, the OFF-switch CAR system polypeptide is encoded by a nucleic acid sequence comprising SEQ ID NOs: 103, 107, 108, 109, 110, 111, 112, 113 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to one of SEQ ID NOs: 106-121 that maintains the same function or a codon-optimized version of one of SEQ ID NOs: 106-121. In some embodiments of any of the aspects, the OFF-switch CAR system polypeptide is encoded by a nucleic acid sequence comprising SEQ ID NOs: 103, 107, 108, 109, 110, 111, 112, 113 or a sequence that is at least 95% identical to one of SEQ ID NOs: 106-121 that maintains the same function or a codon-optimized version of one of SEQ ID NOs: 106-121.

Tables 7 and 8 shows the locations of specific domains in exemplary OFF-Switch CAR system sequences. The nucleic acid numbers are shown first, followed by the amino acid residues.

TABLE 7

OFF-Switch CAR systems (component c constructs)

| Element (SEQ ID NOs) | OFF-CAR_c + i (SEQ ID NO: 106, 114) | OFF-CAR_c + ii (SEQ ID NO: 107, 115) | OFF-CAR_c + iii (SEQ ID NO: 108, 116) | OFF-CAR_c + iv (SEQ ID NO: 109, 117) |
|---|---|---|---|---|
| CD8a leading peptide (7, 40) | 1-63, 1-20 | 1-63, 1-20 | 1-63, 1-20 | 1-63, 1-20 |
| CD19 scFv (70, 94) | 64-789, 21-262 | 64-789, 21-262 | 64-789, 21-262 | 64-789, 21-262 |
| V5 tag (9, 42) | 790-831, 263-276 | 790-831, 263-276 | 790-831, 263-276 | 790-831, 263-276 |
| CD8 hinge (10, 43) | 844-978, 281-325 | 844-978, 281-325 | 844-978, 281-325 | 844-978, 281-325 |
| CD28 transmembrane (11, 44) | 979-1059, 326-352 | 979-1059, 326-352 | 979-1059, 326-352 | 979-1059, 326-352 |
| CD28 ICD (19, 52) | 1060-1182, 353-393 | 1060-1182, 353-393 | 1060-1182, 353-393 | 1060-1182, 353-393 |
| 41BB ICD (20, 53) | | | | |
| CP5-46-5D5E (71, 95) | 1228-1326, 409-441 | 1228-1326, 409-441 | 1228-1326, 409-441 | 1228-1326, 409-441 |
| P2A (122, 123) | 1327-1392, 442-463 | 1327-1392, 442-463 | 1327-1392, 442-463 | 1327-1392, 442-463 |
| DAP10 ectodomain (72, 96) | 1393-1536, 464-511 | 1393-1536, 464-511 | 1393-1536, 464-511 | 1393-1536, 464-511 |
| CD8 transmembrane (73, 97, 124) | 1537-1599, 512-532 | 1537-1599, 512-532 | 1537-1599, 512-532 | 1537-1599, 512-532 |
| 41BB ICD (20, 53) | 1600-1725, 533-574 | 1600-1725, 533-574 | | |
| NS4A (74, 98) | 1726-1761, 575-586 | 2062-2097, 687-698 | 1600-1635, 533-544 | 1936-1971, 645-656 |
| NS3 (75, 99) | 1774-2310, 591-769 | 2100-2646, 703-881 | 1648-2184, 549-727 | 1984-2520, 661-839 |
| CD3z ICD (21, 54) | 2311-2646, 770-881 | 1726-2061, 576-686 | 2185-2520, 728-839 | 1600-1935, 533-644 |
| mCherry (76, 100) | 2650-3360, 883-1118 | 2650-3360, 883-1118 | 2524-3234, 841-1076 | 2524-3234, 841-1076 |

TABLE 8

OFF-Switch CAR systems (component d constructs)

| Element (SEQ ID NOs) | OFF-CAR_d + i (SEQ ID NO: 110, 118) | OFF-CAR_d + ii (SEQ ID NO: 111, 119) | OFF-CAR d + iii (SEQ ID NO: 112, 120) | OFF-CAR_d + iv (SEQ ID NO: 113, 121) |
|---|---|---|---|---|
| CD8a leading peptide (7, 40) | 1-63, 1-20 | 1-63, 1-20 | 1-63, 1-20 | 1-63, 1-20 |
| CD19 scFv (70, 94) | 64-789, 21-262 | 64-789, 21-262 | 64-789, 21-262 | 64-789, 21-262 |
| V5 tag (9, 42) | 790-831, 263-276 | 790-831, 263-276 | 790-831, 263-276 | 790-831, 263-276 |
| CDS hinge (10, 43) | 844-978, 281-325 | 844-978, 281-325 | 844-978, 281-325 | 844-978, 281-325 |
| CD28 transmembrane (11, 44) | 979-1059, 326-352 | 979-1059, 326-352 | 979-1059, 326-352 | 979-1059, 326-352 |
| CD28 ICD (19, 52) | 1060-1182, 353-393 | 1060-1182, 353-393 | 1060-1182, 353-393 | 1060-1182, 353-393 |
| 41BB ICD (20, 53) | 1183-1308, 394-435 | 1183-1308, 394-435 | 1183-1308, 394-435 | 1183-1308, 394-435 |
| CP5-46-5D5E (71, 95) | 1354-1452, 451-483 | 1354-1452, 451-483 | 1354-1452, 451-483 | 1354-1452, 451-483 |
| P2A (122, 123) | 1453-1518, 484-505 | 1453-1518, 484-505 | 1453-1518, 484-505 | 1453-1518, 484-505 |
| DAP10 ectodomain (72, 96) | 1519-1662, 506-553 | 1519-1662, 506-553 | 1519-1662, 506-553 | 1519-1662, 506-553 |
| CD8 transmembrane (73, 97, 124) | 1663-1725, 554-574 | 1663-1725, 554-574 | 1663-1725, 554-574 | 1663-1725, 554-574 |
| 41BB ICD (20, 53) | 1726-1851, 575-616 | 1726-1851, 575-616 | | |
| NS4A (74, 98) | 1852-1887, 617-628 | 2188-2223, 729-740 | 1726-1761, 575-586 | 2062-2097, 687-698 |
| NS3 (75, 99) | 1900-2436, 633-811 | 2236-2772, 745-923 | 1774-2310, 591-769 | 2110-2646, 703-881 |
| CD3z ICD (21, 54) | 2437-2772, 812-923 | 1852-2187, 617-728 | 2311-2646, 770-881 | 1726-2061, 575-686 |
| mCherry (76, 100) | 2776-3486, 925-1160 | 2776-3486, 925-1160 | 2650-3360, 883-1118 | 2650-3360, 883-1118 |

CAR systems comprise two CAR polypeptides, with one polypeptide comprising a repressible protease, and the other polypeptide comprising a reader domain that specifically binds to the repressible protease in the presence of a specific protease inhibitor. One or both of the polypeptides of the reader CAR system comprises an extracellular binding domain (e.g., specific for a tumor antigen), and one or both polypeptides comprise at least one intracellular signaling domain such that when the two polypeptides are brought into close proximity, binding of the cognate antigen to the extracellular binding domain results in intracellular signaling of the reader CAR system. In the presence of the specific protease inhibitor, the two polypeptides of the reader CAR system are brought together, and intracellular signaling occurs when the cognate antigen is also present. In the absence of the specific protease inhibitor, the reader domain does not bind the repressible protease, the two polypeptides of the reader CAR system are not recruited together, and no intracellular signaling occurs, even in the presence of the cognate antigen. In the presence of the another protease inhibitor that binds to the protease inhibitor but does not bind to the specific reader domain, the two polypeptides of the reader CAR system are not recruited together, and no intracellular signaling occurs, even in the presence of the cognate antigen. Thus, this drug-inducible system can only be turned on in the presence of the specific protease inhibitor that allows the repressible protease to bind to the reader domain.

In one aspect described herein is a first polypeptide of a reader CAR system, comprising: (a) an extracellular binding domain; (b) a transmembrane domain; and (c) a reader domain. In some embodiments of any of the aspects, the extracellular binding domain (e.g., of the first polypeptide of a reader CAR system) is N-terminal to the transmembrane domain, and the transmembrane domain to N-terminal to the intracellular domains (e.g., a reader domain). In some embodiments of any of the aspects, the first polypeptide of a reader CAR system further comprises at least one intracellular signaling domain as described further herein. In some embodiments of any of the aspects, the at least one intracellular signaling domain (e.g., of the first polypeptide of a reader CAR system) is N-terminal to the reader domain. In some embodiments of any of the aspects, the reader domain (e.g., of the first polypeptide of a reader CAR system) is N-terminal to the at least one intracellular signaling domain. In some embodiments of any of the aspects, the reader domain (e.g., of the first polypeptide of a reader CAR system) is N-terminal to at least one intracellular signaling domain and C-terminal to at least one intracellular signaling domain.

In some embodiments of any of the aspects, the reader domain of the first polypeptide (e.g., of the reader CAR system) comprises the danoprevir/NS3 complex reader domain (DNCR). In some embodiments of any of the aspects, the reader domain of the first polypeptide (e.g., of the reader CAR system) comprises the grazoprevir/NS3 complex reader domain (GNCR). In some embodiments of any of the aspects, the reader domain of the first polypeptide (e.g., of the reader CAR system) comprises DNCR2 (e.g., SEQ ID NO: 77, 101); GNCR1 (e.g., SEQ ID NO: 81, 105); or another reader domain as described herein. In some embodiments of any of the aspects, the first polypeptide (e.g., of the reader CAR system) comprises 1, 2, 3, 4, or at least 5 reader domains. In some embodiments of any of the aspects, the CAR polypeptide or system comprises one reader domain. In embodiments comprising multiple reader domains, the multiple reader domains can be different individual reader domains or multiple copies of the same reader domain, or a combination of the foregoing. In some embodiments of any of the aspects, the reader domain is at the C-terminus of the first reader CAR polypeptide. In some embodiments of any of the aspects, the first reader CAR polypeptide does not comprise any protease cleavage sites for the repressible protease of the second reader CAR polypeptide.

In some embodiments of any of the aspects, the reader domain of the first reader CAR polypeptide as described herein comprises SEQ ID NOs: 101 or 105 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 101 or 105 that maintains the same functions as one of SEQ ID NOs: 101 or 105 (e.g., binding to a repressible protease in the presence of a specific protease inhibitor). In some embodiments of any of the aspects, the reader domain of the first reader CAR polypeptide as described herein comprises SEQ ID NOs: 101 or 105, or an amino acid sequence that is at least 95% identical to the sequence of one of SEQ ID NOs: 101 or 105 that maintains the same function.

In some embodiments of any of the aspects, the reader domain of the first reader CAR polypeptide as described herein is encoded by a nucleic sequence comprising SEQ ID NO: 77, 81 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NOs: 77 or 81 that maintains the same function or a codon-optimized version of SEQ ID NOs: 77 or 81. In some embodiments of any of the aspects, the reader domain of the first reader CAR polypeptide as described herein is encoded by a nucleic sequence comprising SEQ ID NOs: 77, 81 or a sequence that is at least 95% identical to SEQ ID NOs: 77 or 81 that maintains the same function.

In some embodiments of any of the aspects, the first polypeptide (e.g., of the reader CAR system) is referred to as "component a." In some embodiments of any of the aspects, the "a" component (e.g., of the reader CAR system) comprises from the N-terminus to the C-terminus: (a) an extracellular binding domain (e.g., SEQ ID NO: 70, 94); (b) a transmembrane domain (e.g., SEQ ID NO: 11, 44); and (c) a reader domain (e.g., SEQ ID NO: 77, 81, 101, 105). In some embodiments of any of the aspects, the first polypeptide of a reader CAR system does not comprise any intracellular signaling domains (e.g., the "a component").

In some embodiments of any of the aspects, the component a polypeptide (e.g., of the reader CAR system) as described herein comprises SEQ ID NOs: 94, 44, and 101, or SEQ ID NOs: 94, 44, and 105, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to a sequence comprising SEQ ID NOs: 94, 44, and 101, or SEQ ID NOs: 94, 44, and 105, that maintains the same functions as SEQ ID NOs: 94, 44, and 101 or 105. In some embodiments of any of the aspects, the component a polypeptide (e.g., of the reader CAR system) as described herein comprises SEQ ID NOs: 94, 44, and 101, or SEQ ID NOs: 94, 44, and 105, or an amino acid sequence that is at least 95% identical to a sequence comprising SEQ ID NOs: 94, 44, and 101, or SEQ ID NOs: 94, 44, and 105, that maintains the same function.

In some embodiments of any of the aspects, the component a polypeptide (e.g., of the reader CAR system) as described herein is encoded by a nucleic acid sequence comprising SEQ ID NOs: 70, 11, and 77, or SEQ ID NOs: 70, 11, and 81, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to a sequence comprising SEQ ID NOs: 70, 11, and 77, or SEQ ID NOs: 70, 11, and 81, that maintains the same function or a codon-optimized version thereof. In some embodiments of any of the aspects, the component a polypeptide (e.g., of the reader CAR system) as described herein is encoded by a nucleic acid sequence comprising SEQ ID NOs: 70, 11, and 77, or SEQ ID NOs: 70, 11, and 81, or a sequence that is at least 95% identical to a sequence comprising SEQ ID NOs: 70, 11, and 77, or SEQ ID NOs: 70, 11, and 81, that maintains the same function.

In some embodiments of any of the aspects, the first polypeptide (e.g., of the reader CAR system) is referred to as "component b", "component c" or "component d." In some embodiments of any of the aspects, the component b, c, or d polypeptide (e.g., of the reader CAR system) comprises from the N-terminus to the C-terminus: (a) an extracellular binding domain; (b) a transmembrane domain; (c) at least one intracellular signaling domain; and (d) a reader domain. In some embodiments of any of the aspects, the component b or c polypeptide (e.g., of the reader CAR system) comprises from the N-terminus to the C-terminus: (a) an extracellular binding domain; (b) a transmembrane domain; (c) a single intracellular signaling domain; and (d) a reader domain.

In some embodiments of any of the aspects, the component b polypeptide (e.g., of the reader CAR system) comprises the intracellular signaling domain of 4-1BB (e.g., SEQ ID NO: 20, 53) as the single intracellular signaling domain. In some embodiments of any of the aspects, the component b polypeptide (e.g., of the reader CAR system) comprises from the N-terminus to the C-terminus: (a) an extracellular binding domain (e.g., SEQ ID NO: 70, 94); (b) a transmembrane domain (e.g., SEQ ID NO: 11, 44); (c) a 4-1BB intracellular signaling domain (e.g., SEQ ID NO: 20, 53); and (d) a reader domain (e.g., SEQ ID NO: 77, 81, 101, 105).

In some embodiments of any of the aspects, the component b polypeptide (e.g., of the reader CAR system) as described herein comprises SEQ ID NOs: 94, 44, 53, and 101, or SEQ ID NOs: 94, 44, 53, and 105, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to a sequence comprising SEQ ID NOs: 94, 44, 53, and 101, or SEQ ID NOs: 94, 44, 53, and 105, that maintains the same functions as SEQ ID NOs: 94, 44, 53, and 101 or 105. In some embodiments of any of the aspects, the component b polypeptide (e.g., of the reader CAR system) as described herein comprises SEQ ID NOs: 94, 44, 53, and 101, or SEQ ID NOs: 94, 44, 53, and 105, or an amino acid sequence that is at least 95% identical to a sequence comprising SEQ ID NOs: 94, 44, 53, and 101, or SEQ ID NOs: 94, 44, 53, and 105, that maintains the same function.

In some embodiments of any of the aspects, the component b polypeptide (e.g., of the reader CAR system) as described herein is encoded by a nucleic acid sequence comprising SEQ ID NOs: 70, 11, 20, and 77, or SEQ ID NOs: 70, 11, 20, and 81, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to a sequence comprising SEQ ID NOs: 70, 11, 20, and 77, or SEQ ID NOs: 70, 11, 20, and 81, that maintains the same function or a codon-optimized version thereof. In some embodiments of any of the aspects, the component b polypeptide (e.g., of the reader CAR system) as described herein is encoded by a nucleic acid sequence comprising SEQ ID NOs: 70, 11, 20, and 77, or SEQ ID NOs: 70, 11, 20, and 81, or a sequence that is at least 95% identical to a sequence comprising SEQ ID NOs: 70, 11, 20, and 77, or SEQ ID NOs: 70, 11, 20, and 81, that maintains the same function.

In some embodiments of any of the aspects, the component c polypeptide (e.g., of the reader CAR system) comprises the intracellular signaling domain of CD28 (e.g., SEQ ID NO: 19, 52) as the single intracellular signaling domain. In some embodiments of any of the aspects, the component c polypeptide (e.g., of the reader CAR system) comprises from the N-terminus to the C-terminus: (a) an extracellular binding domain (e.g., SEQ ID NO: 70, 94); (b) a transmembrane domain (e.g., SEQ ID NO: 11, 44); (c) a CD28 intracellular signaling domain (e.g., SEQ ID NO: 19, 52); and (d) a reader domain (e.g., SEQ ID NO: 77, 81, 101, 105).

In some embodiments of any of the aspects, the component c polypeptide (e.g., of the reader CAR system) as described herein comprises SEQ ID NOs: 94, 44, 52, and 101, or SEQ ID NOs: 94, 44, 52, and 105, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to a sequence comprising SEQ ID NOs: 94, 44, 52, and 101, or SEQ ID NOs: 94, 44, 52, and 105, that maintains the same functions as SEQ ID NOs: 94, 44, 52, and 101 or 105. In some embodiments of any of the aspects, the component c polypeptide (e.g., of the reader CAR system) as described herein comprises SEQ ID NOs: 94, 44, 52, and 101, or SEQ ID NOs: 94, 44, 52, and 105, or an amino acid sequence that is at least 95% identical to a sequence comprising SEQ ID NOs: 94, 44, 52, and 101, or SEQ ID NOs: 94, 44, 52, and 105, that maintains the same function.

In some embodiments of any of the aspects, the component c polypeptide (e.g., of the reader CAR system) as described herein is encoded by a nucleic acid sequence comprising SEQ ID NOs: 70, 11, 19, and 77, or SEQ ID NOs: 70, 11, 19, and 81, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to a sequence comprising SEQ ID NOs: 70, 11, 19, and 77, or SEQ ID NOs: 70, 11, 19, and 81, that maintains the same function or a codon-optimized version thereof. In some embodiments of any of the aspects, the component c polypeptide (e.g., of the reader CAR system) as described herein is encoded by a nucleic acid sequence comprising SEQ ID NOs: 70, 11, 19, and 77, or SEQ ID NOs: 70, 11, 19, and 81, or a sequence that is at least 95% identical to a sequence comprising SEQ ID NOs: 70, 11, 19, and 77, or SEQ ID NOs: 70, 11, 19, and 81, that maintains the same function.

In some embodiments of any of the aspects, the component c polypeptide (e.g., of the reader CAR system) comprises residues 1-626 of SEQ ID NO: 90, residues 1-630 of SEQ ID NO: 92, residues 1-626 of SEQ ID NO: 127, or residues 1-630 of SEQ ID NO: 128, an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to a sequence comprising residues 1-626 of SEQ ID NO: 90, residues 1-630 of SEQ ID NO: 92, residues 1-626 of SEQ ID NO: 127, or residues 1-630 of SEQ ID NO: 128, that maintains the same functions (e.g., target cell binding, reader domain, etc.). In some embodiments of any of the aspects, the component c polypeptide (e.g., of the reader CAR system) comprises residues 1-626 of SEQ ID NO: 90, residues 1-630 of SEQ ID NO: 92, residues 1-626 of SEQ ID NO: 127, or residues 1-630 of SEQ ID NO: 128, an amino acid sequence that is at least 95% identical to a sequence comprising residues 1-626 of SEQ ID NO: 90, residues 1-630 of SEQ ID NO: 92, residues 1-626 of SEQ ID NO: 127, or residues 1-630 of SEQ ID NO: 128, that maintains the same function.

In some embodiments of any of the aspects, the component c polypeptide (e.g., of the reader CAR system) is encoded by a nucleic acid sequence comprising nucleotides 1-1881 of SEQ ID NO: 66, nucleotides 1-1893 of SEQ ID NO: 68, nucleotides 1-1881 of SEQ ID NO: 125, nucleotides 1-1893 of SEQ ID NO: 126, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to a sequence comprising nucleotides 1-1881 of SEQ ID NO: 66, nucleotides 1-1893 of SEQ ID NO: 68, nucleotides 1-1881 of SEQ ID NO: 125, nucleotides 1-1893 of SEQ ID NO: 126 that maintains the same function or a codon-optimized version of nucleotides 1-1881 of SEQ ID NO: 66, nucleotides 1-1893 of SEQ ID NO: 68, nucleotides 1-1881 of SEQ ID NO: 125, nucleotides 1-1893 of SEQ ID NO: 126. In some embodiments of any of the aspects, the component c polypeptide (e.g., of the reader CAR system) is encoded by a nucleic acid sequence comprising nucleotides 1-1881 of SEQ ID NO: 66, nucleotides 1-1893 of SEQ ID NO: 68, nucleotides 1-1881 of SEQ ID NO: 125, nucleotides 1-1893 of SEQ ID NO: 126, or a sequence that is at least 95% identical to a sequence comprising nucleotides 1-1881 of SEQ ID NO: 66, nucleotides 1-1893 of SEQ ID NO: 68, nucleotides 1-1881 of SEQ ID NO: 125, nucleotides 1-1893 of SEQ ID NO: 126 that maintains the same function.

In some embodiments of any of the aspects, the component d polypeptide (e.g., of the reader CAR system) comprises from the N-terminus to the C-terminus: (a) an extracellular binding domain; (b) a transmembrane domain; (c) a first intracellular signaling domain; (d) a second intracellular signaling domain; and (e) a reader domain. In some embodiments of any of the aspects, the first (or second) intracellular signaling domain of the component d polypeptide (e.g., of the reader CAR system) comprises the intracellular signaling domain of CD28 (e.g., SEQ ID NO: 19, 52). In some embodiments of any of the aspects, the second (or first) intracellular signaling domain of the component d polypeptide (e.g., of the reader CAR system) comprises the intracellular signaling domain of 4-1BB (e.g., SEQ ID NO: 20, 53). In some embodiments of any of the aspects, the component d polypeptide (e.g., of the reader CAR system) comprises from the N-terminus to the C-terminus: (a) an extracellular binding domain (e.g., SEQ ID NO: 70, 94); (b) a transmembrane domain (e.g., SEQ ID NO: 11, 44); (c) a CD28 intracellular signaling domain (e.g., SEQ ID NO: 19, 52); (d) a 4-1BB intracellular signaling domain (e.g., SEQ ID NO: 20, 53); and (e) a reader domain (e.g., SEQ ID NO: 77, 81, 101, 105).

In some embodiments of any of the aspects, the component d polypeptide (e.g., of the reader CAR system) as described herein comprises SEQ ID NOs: 94, 44, 52, 53, and 101, or SEQ ID NOs: 94, 44, 52, 53, and 105, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to a sequence comprising SEQ ID NOs: 94, 44, 52, 53, and 101, or SEQ ID NOs: 94, 44, 52, 53, and 105, that maintains the same functions as SEQ ID NOs: 94, 44, 52, 53, and 101 or 105. In some embodiments of any of the aspects, the component d polypeptide (e.g., of the reader CAR system) as described herein comprises SEQ ID NOs: 94, 44, 52, 53, and 101, or SEQ ID NOs: 94, 44, 52, 53, and 105, or an amino acid sequence that is at least 95% identical to a sequence comprising SEQ ID NOs: 94, 44, 52, 53, and 101, or SEQ ID NOs: 94, 44, 52, 53, and 105, that maintains the same function.

In some embodiments of any of the aspects, the component d polypeptide (e.g., of the reader CAR system) as described herein is encoded by a nucleic acid sequence comprising SEQ ID NOs: 70, 11, 19, 20, and 77, or SEQ ID NOs: 70, 11, 19, 20, and 81, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to a sequence comprising SEQ ID NOs: 70, 11, 19, 20, and 77, or SEQ ID NOs: 70, 11, 19, 20, and 81, that maintains the same function or a codon-optimized version thereof. In some embodiments of any of the aspects, the component d polypeptide (e.g., of the reader CAR system) as described herein is encoded by a nucleic acid sequence comprising SEQ ID NOs: 70, 11, 19, 20, and 77, or SEQ ID NOs: 70, 11, 19, 20, and 81, or a sequence that is at least 95% identical to a sequence comprising SEQ ID NOs: 70, 11, 19, 20, and 77, or SEQ ID NOs: 70, 11, 19, 20, and 81, that maintains the same function.

In some embodiments of any of the aspects, the component d polypeptide (e.g., of the reader CAR system) comprises residues 1-668 of SEQ ID NO: 91, residues 1-672 of SEQ ID NO: 93, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to a sequence comprising residues 1-668 of SEQ ID NO: 91 or residues 1-672 of SEQ ID NO: 93 that maintains the same functions as SEQ ID NO: 85 (e.g., target cell binding, reader domain etc.). In some embodiments of any of the aspects, the component d polypeptide (e.g., of the reader CAR system) comprises residues 1-668 of SEQ ID NO: 91, residues 1-672 of SEQ ID NO: 93, or an amino acid sequence that is at least 95% identical to a sequence comprising residues 1-668 of SEQ ID NO: 91 or residues 1-672 of SEQ ID NO: 93 that maintains the same function.

In some embodiments of any of the aspects, the component d polypeptide (e.g., of the reader CAR system) is encoded by a nucleic acid sequence comprising nucleotides 1-2007 of SEQ ID NO: 67, nucleotides 1-2019 of SEQ ID NO: 69 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to a sequence comprising nucleotides 1-2007 of SEQ ID NO: 67 or nucleotides 1-2019 of SEQ ID NO: 69 that maintains the same function or a codon-optimized version of nucleotides 1-2007 of SEQ ID NO: 67 or nucleotides 1-2019 of SEQ ID NO: 69. In some embodiments of any of the aspects, the component d polypeptide (e.g., of the reader CAR system) is encoded by a nucleic acid sequence comprising nucleotides 1-2007 of SEQ ID NO: 67, nucleotides 1-2019 of SEQ ID NO: 69 or a sequence that is at least 95% identical to a sequence comprising nucleotides 1-2007 of SEQ ID NO: 67 or nucleotides 1-2019 of SEQ ID NO: 69 that maintains the same function.

In some embodiments of any of the aspects, the extracellular binding domain of the first reader CAR polypeptide is an antibody, an antigen-binding fragment thereof, a F(ab) fragment, a F(ab') fragment, a single chain variable fragment (scFv), or a single-domain antibody (sdAb). In some embodiments of any of the aspects, the extracellular binding domain of the first reader CAR polypeptide comprises a scFv. In some embodiments of any of the aspects, the extracellular binding domain of the first reader CAR polypeptide binds to a tumor antigen, as described further herein. In some embodiments of any of the aspects, the first reader CAR polypeptide comprises a leading peptide located N-terminal to the extracellular binding domain. In some embodiments of any of the aspects, the leading peptide is CD8alpha leading peptide or another leading peptide as described herein.

In some embodiments of any of the aspects, the transmembrane domain is located between the extracellular binding domain and the at least one intracellular signaling domain. The transmembrane domain of the first reader CAR polypeptide can be any known transmembrane domain. In one embodiment, the transmembrane domain of the first reader CAR polypeptide comprises the transmembrane domain of CD28. In some embodiments of any of the aspects, the first reader CAR polypeptide comprises a spacer domain located between the extracellular binding domain and the transmembrane domain. In some embodiments of any of the aspects, the spacer domain comprises a CD8a hinge domain or another spacer domain as described herein.

In some embodiments of any of the aspects, the first reader CAR polypeptide comprises 0, 1, 2, 3, 4, 5, or more intracellular signaling domains. In embodiments comprising multiple intracellular signaling domains, the multiple repressible proteases can be different individual intracellular signaling domains or multiple copies of the same intracellular signaling domain, or a combination of the foregoing. In some embodiments of any of the aspects, the intracellular signaling domain (e.g., of the first reader CAR polypeptide), if it is present, comprises at least one intracellular signaling domain selected from the group consisting of: TCRC; FcRy; FcRp; CD3zeta; CD3y; CD3S; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-Ll); CD278 (ICOS); DAP10; LAT; KD2C SLP76; TRIM; ZAP70; and 41BB. In some embodiments of any of the aspects, the first reader CAR polypeptide comprises the intracellular signaling domain of CD28 and/or 4-1BB.

In some embodiments of any of the aspects, the first reader CAR polypeptide comprises at least one detectable marker as described herein. As a non-limiting example, the at least one detectable marker can be used to detect the expression of the first reader CAR polypeptide. In some embodiments of any of the aspects, the first reader CAR polypeptide comprises a detectable marker adjacent to and C terminal of the extracellular binding domain. As a non-limiting example, the detectable marker(s) can be selected from GFP, V5, HA1, Myc, VSV-G, HSV, FLAG, HIS, mCherry, AU1, and biotin or another detectable marker as described herein (see e.g., Tables 5 and 9).

Figure 12A:
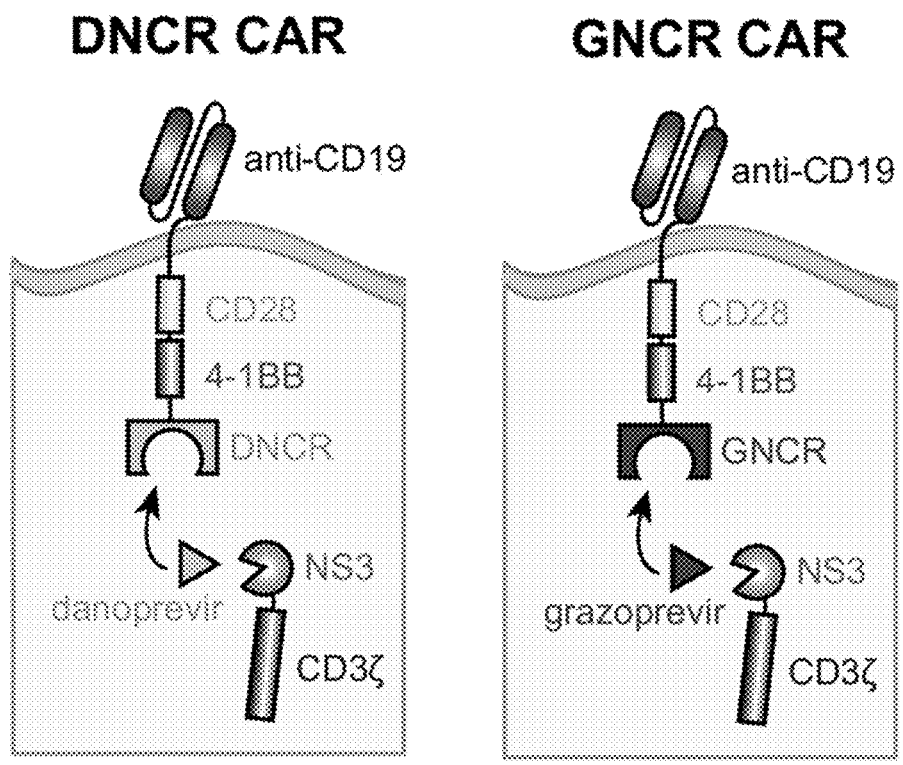
FIG. 12A-12C is a series of schematics and graphs showing the design and function of the NS3 reader CARs in Jurkat T cells.

In one aspect described herein is a second polypeptide of a reader CAR system, comprising: (a) a repressible protease and (b) at least one intracellular signaling domain. In some embodiments of any of the aspects, the second polypeptide of a reader CAR system does not comprise an extracellular domain and/or a transmembrane; accordingly, the second polypeptide of a reader CAR system can be an intracellular protein, as opposed to a transmembrane protein (see e.g., FIG. 12A).

In one aspect described herein is a second polypeptide of a reader CAR system, comprising: (a) an extracellular domain; (b) a transmembrane domain; (c) a repressible protease; and (d) at least one intracellular signaling domain. In some embodiments of any of the aspects, the extracellular domain (e.g., of the second polypeptide of a reader CAR system) is N-terminal to the transmembrane domain, and the transmembrane domain to N-terminal to the intracellular domains (e.g., repressible protease and at least one intracellular signaling domain). In some embodiments of any of the aspects, the at least one intracellular signaling domain (e.g., of the second polypeptide of a reader CAR system) is N-terminal to the repressible protease. In some embodiments of any of the aspects, the repressible protease (e.g., of the second polypeptide of a reader CAR system) is N-terminal to the at least one intracellular signaling domain. In some embodiments of any of the aspects, the repressible protease (e.g., of the second polypeptide of a reader CAR system) is N-terminal to at least one intracellular signaling domain and C-terminal to at least one intracellular signaling domain.

In some embodiments of any of the aspects, the second reader CAR polypeptide comprises 1, 2, 3, 4, 5, or more repressible protease(s). In embodiments comprising multiple repressible proteases, the multiple repressible proteases can be different individual repressible proteases or multiple copies of the same repressible protease, or a combination of the foregoing. In one embodiment, the second reader CAR polypeptide comprises one repressible protease. In some embodiments of any of the aspects, the repressible protease (e.g., of the second reader CAR polypeptide) is hepatitis C virus (HCV) nonstructural protein 3 (NS3). In some embodiments of any of the aspects, the repressible protease of the second reader CAR polypeptide comprises NS3 genotype 1A (e.g., SEQ ID NO: 79, 103). In some embodiments of any of the aspects, the repressible protease of the second reader CAR polypeptide comprises NS3 genotype 1B (e.g., SEQ ID NO: 75, 99).

In some embodiments of any of the aspects, the repressible protease of the second reader CAR polypeptide as described herein comprises SEQ ID NOs: 99, 103, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NOs: 99 or 103 that maintains the same function. In some embodiments of any of the aspects, the repressible protease of the second reader CAR polypeptide as described herein comprises SEQ ID NOs: 99 or 103, or an amino acid sequence that is at least 95% identical to the sequence of SEQ ID NOs: 99 or 103, that maintains the same function.

In some embodiments of any of the aspects, the repressible protease of the second reader CAR polypeptide as described herein is encoded by a nucleic acid sequence comprising SEQ ID NOs: 75, 79 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NOs: 75 or 79, that maintains the same function or a codon-optimized version of SEQ ID NOs: 75 or 79. In some embodiments of any of the aspects, the repressible protease of the second reader CAR polypeptide as described herein is encoded by a nucleic acid sequence comprising SEQ ID NOs: 75 or 79, or a sequence that is at least 95% identical to SEQ ID NOs: 75 or 79, that maintains the same function.

In some embodiments of any of the aspects, the repressible protease of the second reader CAR polypeptide is catalytically inactive (i.e., dead). For NS3 genotypes 1A and 1B, the catalytic triad comprises His-57, Asp-81, and Ser-139. Accordingly, a catalytically inactive NS3 protease can comprise a nonsynonymous mutation at any one of His-57, Asp-81, and Ser-139, or another inactivating mutation as described herein. In some embodiments of any of the aspects, the NS3 protease (e.g., of the second reader CAR polypeptide) comprises an S139A mutation. In regard to a repressible protease, "catalytically inactive" refers to the inability to cleave at a protease cleavage site. In some embodiments of any of the aspects, the catalytically inactive repressible protease retains the ability to specifically bind to the reader domain of the first reader CAR polypeptide in the presence of a specific protease inhibitor, but the catalytically inactive repressible protease does not cleave the reader domain. In some embodiments of any of the aspects, the second reader CAR polypeptide does not comprise any protease cleavage sites for the repressible protease. In some embodiments of any of the aspects, the repressible protease (e.g., of the second reader CAR polypeptide) can be any repressible protease as described further herein, e.g., that binds to the reader domain of the first reader CAR polypeptide.

In some embodiments of any of the aspects, the repressible protease (e.g., of the second reader CAR polypeptide) is located: (a) between the transmembrane domain and the at least one intracellular signaling domain; (b) between the first intracellular signaling domain and the second intracellular signaling domain; or (c) at the C terminus of the polypeptide. In some embodiments of any of the aspects, the repressible protease (e.g., of the second reader CAR polypeptide) is located: (a) between the transmembrane domain and the at least one intracellular signaling domain. In some embodiments of any of the aspects, the repressible protease (e.g., of the second reader CAR polypeptide) is located: (b) between the first intracellular signaling domain and the second intracellular signaling domain. In some embodiments of any of the aspects, the repressible protease (e.g., of the second reader CAR polypeptide) is located: (c) at the C terminus of the polypeptide.

In some embodiments of any of the aspects, the repressible protease (e.g., of the second reader CAR polypeptide) is located: (a) between the transmembrane domain and the at least one intracellular signaling domain; and (b) between the first intracellular signaling domain and the second intracellular signaling domain. In some embodiments of any of the aspects, the repressible protease (e.g., of the second reader CAR polypeptide) is located: (a) between the transmembrane domain and the at least one intracellular signaling domain; and (c) at the C terminus of the polypeptide. In some embodiments of any of the aspects, the repressible protease (e.g., of the second reader CAR polypeptide) is located: (b) between the first intracellular signaling domain and the second intracellular signaling domain; and (c) at the C terminus of the polypeptide. In some embodiments of any of the aspects, the repressible protease (e.g., of the second reader CAR polypeptide) is located: (a) between the transmembrane domain and the at least one intracellular signaling domain; (b) between the first intracellular signaling domain and the second intracellular signaling domain; and (c) at the C terminus of the polypeptide.

In some embodiments of any of the aspects, the second reader CAR polypeptide is in combination with a protease inhibitor bound to the repressible protease. In some embodiments of any of the aspects, the second reader CAR polypeptide is bound to a protease inhibitor bound to the repressible protease. In some embodiments of any of the aspects, the second reader CAR polypeptide is bound specifically to a protease inhibitor bound to the repressible protease. Non-limiting examples of protease inhibitors (e.g., for NS3) include grazoprevir (GZV), danoprevir, simeprevir, asunaprevir, ciluprevir, boceprevir, sovaprevir, paritaprevir, ombitasvir, paritaprevir, ritonavir, dasabuvir, and telaprevir; further examples are described herein.

In some embodiments of any of the aspects, the protease inhibitor is specific to the reader domain of the first reader CAR polypeptide. As a non-limiting example, grazoprevir is in combination with the second reader CAR polypeptide, and the first reader CAR polypeptide comprises a GNCR reader domain. As another non-limiting example, danoprevir is in combination with the second reader CAR polypeptide, and the first reader CAR polypeptide comprises a DNCR reader domain. In some embodiments of any of the aspects, the second reader CAR polypeptide binds to the reader domain of the first reader CAR polypeptide when the specific protease inhibitor is bound to the repressible protease.

In some embodiments of any of the aspects, the second reader CAR polypeptide further comprises a cofactor for the repressible protease. In some embodiments of any of the aspects, the cofactor (e.g., for NS3) is an HSV NS4A domain, as described further herein. In one embodiment, the second reader CAR polypeptide comprises genotype 1A NS4A (e.g., SEQ ID NO: 15, 48). In some embodiments of any of the aspects, the HSV NS4A domain is adjacent and N-terminal to the repressible protease (e.g., NS3).

In some embodiments of any of the aspects, the cofactor for the repressible protease of the second reader CAR polypeptide as described herein comprises SEQ ID NO: 48, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 48 that maintains the same function. In some embodiments of any of the aspects, the cofactor for the repressible protease of the second reader CAR polypeptide as described herein comprises SEQ ID NO: 48, or an amino acid sequence that is at least 95% identical to the sequence of SEQ ID NO: 48 that maintains the same function.

In some embodiments of any of the aspects, the cofactor for the repressible protease of the second reader CAR polypeptide as described herein is encoded by a nucleic acid sequence comprising SEQ ID NO: 15, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 15 that maintains the same function or a codon-optimized version of SEQ ID NO: 15. In some embodiments of any of the aspects, the cofactor for the repressible protease of the second reader CAR polypeptide as described herein is encoded by a nucleic acid sequence comprising SEQ ID NO: 15, or a sequence that is at least 95% identical to SEQ ID NO: 15 that maintains the same function.

In some embodiments of any of the aspects, the second polypeptide (e.g., of the reader CAR system) is referred to as "component i." In some embodiments of any of the aspects, the component i polypeptide (e.g., of the reader CAR system) comprises from the N-terminus to the C-terminus: (a) an extracellular domain; (b) a transmembrane domain; (c) at least one intracellular signaling domain; (d) a repressible protease; and (e) at least one intracellular signaling domain. In some embodiments of any of the aspects, the component i polypeptide (e.g., of the reader CAR system) comprises from the N-terminus to the C-terminus: (a) an extracellular domain; (b) a transmembrane domain; (c) a first intracellular signaling domain; (d) a repressible protease; and (e) a second intracellular signaling domain. In some embodiments of any of the aspects, the first intracellular signalling domain of component i (e.g., of the second reader CAR polypeptide) comprises the intracellular signaling domain of 4-1BB. In some embodiments of any of the aspects, the second intracellular signalling domain of component i (e.g., of the second reader CAR polypeptide) comprises the intracellular signaling domain of CD3zeta.

In some embodiments of any of the aspects, the component i polypeptide (e.g., of the reader CAR system) comprises SEQ ID NO: 86, residues 648-1313 of SEQ ID NO: 90, residues 690-1355 of SEQ ID NO: 91, residues 652-1317 of SEQ ID NO: 92, residues 694-1359 of SEQ ID NO: 93, residues 648-1303 of SEQ ID NO: 127, or residues 652-1307 of SEQ ID NO: 128, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 86, residues 648-1313 of SEQ ID NO: 90, residues 690-1355 of SEQ ID NO: 91, residues 652-1317 of SEQ ID NO: 92, residues 694-1359 of SEQ ID NO: 93, residues 648-1303 of SEQ ID NO: 127, or residues 652-1307 of SEQ ID NO: 128, that maintains the same functions (e.g., CD3zeta signaling, etc.). In some embodiments of any of the aspects, the component i polypeptide (e.g., of the reader CAR system) comprises residues 648-1313 of SEQ ID NO: 90, residues 690-1355 of SEQ ID NO: 91, residues 652-1317 of SEQ ID NO: 92, residues 694-1359 of SEQ ID NO: 93, residues 648-1303 of SEQ ID NO: 127, or residues 652-1307 of SEQ ID NO: 128, SEQ ID NO: 86, or an amino acid sequence that is at least 95% identical to SEQ ID NO: 86, residues 648-1313 of SEQ ID NO: 90, residues 690-1355 of SEQ ID NO: 91, residues 652-1317 of SEQ ID NO: 92, residues 694-1359 of SEQ ID NO: 93, residues 648-1303 of SEQ ID NO: 127, or residues 652-1307 of SEQ ID NO: 128, that maintains the same function.

In some embodiments of any of the aspects, the component i polypeptide (e.g., of the reader CAR system) is encoded by a nucleic acid sequence comprising SEQ ID NO: 62, nucleotides 1945-3942 of SEQ ID NO: 66, nucleotides 2071-4068 of SEQ ID NO: 67, nucleotides 1957-3954 of SEQ ID NO: 68, nucleotides 2083-4080 of SEQ ID NO: 69, nucleotides 1945-3915 of SEQ ID NO: 125, nucleotides 1957-3927 of SEQ ID NO: 126, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to a sequence comprising SEQ ID NO: 62, nucleotides 1945-3942 of SEQ ID NO: 66, nucleotides 2071-4068 of SEQ ID NO: 67, nucleotides 1957-3954 of SEQ ID NO: 68, nucleotides 2083-4080 of SEQ ID NO: 69, nucleotides 1945-3915 of SEQ ID NO: 125, or nucleotides 1957-3927 of SEQ ID NO: 126, that maintains the same function or a codon-optimized version thereof. In some embodiments of any of the aspects, the component i polypeptide (e.g., of the reader CAR system) is encoded by a nucleic acid sequence comprising SEQ ID NO: 62, nucleotides 1945-3942 of SEQ ID NO: 66, nucleotides 2071-4068 of SEQ ID NO: 67, nucleotides 1957-3954 of SEQ ID NO: 68, nucleotides 2083-4080 of SEQ ID NO: 69, nucleotides 1945-3915 of SEQ ID NO: 125, or nucleotides 1957-3927 of SEQ ID NO: 126, or a sequence that is at least 95% identical to a sequence comprising SEQ ID NO: 62, nucleotides 1945-3942 of SEQ ID NO: 66, nucleotides 2071-4068 of SEQ ID NO: 67, nucleotides 1957-3954 of SEQ ID NO: 68, nucleotides 2083-4080 of SEQ ID NO: 69, nucleotides 1945-3915 of SEQ ID NO: 125, or nucleotides 1957-3927 of SEQ ID NO: 126, that maintains the same function.

In some embodiments of any of the aspects, the second polypeptide (e.g., of the reader CAR system) is referred to as "component ii" or "component iv." In some embodiments of any of the aspects, the component ii or component iv polypeptide (e.g., of the reader CAR system) comprises from the N-terminus to the C-terminus: (a) an extracellular domain; (b) a transmembrane domain; (c) at least one intracellular signaling domain; and (d) a repressible protease. In some embodiments of any of the aspects, the component ii polypeptide (e.g., of the reader CAR system) comprises from the N-terminus to the C-terminus: (a) an extracellular domain (e.g., SEQ ID NO: 72, 96); (b) a transmembrane domain (e.g., SEQ ID NO: 73, 97); (c) a first intracellular signaling domain; (d) a second intracellular signaling domain; and (e) a repressible protease (e.g., SEQ ID NO: 75, 79, 99, 103).

In some embodiments of any of the aspects, the first intracellular signalling domain of component ii (e.g., of the second reader CAR polypeptide) comprises the intracellular signaling domain of 4-1BB (e.g., SEQ ID NO: 20, 53). In some embodiments of any of the aspects, the second intracellular signalling domain of component ii (e.g., of the second reader CAR polypeptide) comprises the intracellular signaling domain of CD3zeta (e.g., SEQ ID NO: 21, 54).

In some embodiments of any of the aspects, the component ii polypeptide (e.g., of the reader CAR system) as described herein comprises SEQ ID NOs: 96, 97, 53, 54, and 99, or SEQ ID NOs: 96, 97, 53, 54, and 103, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to a sequence comprising SEQ ID NOs: 96, 97, 53, 54, and 99, or SEQ ID NOs: 96, 97, 53, 54, and 103, that maintains the same functions as SEQ ID NOs: 96, 97, 53, 54, and 99 or 103. In some embodiments of any of the aspects, the component ii polypeptide (e.g., of the reader CAR system) as described herein comprises SEQ ID NOs: 96, 97, 53, 54, and 99, or SEQ ID NOs: 96, 97, 53, 54, and 103, or an amino acid sequence that is at least 95% identical to a sequence comprising SEQ ID NOs: 96, 97, 53, 54, and 99, or SEQ ID NOs: 96, 97, 53, 54, and 103, that maintains the same functions as SEQ ID NOs: 96, 97, 53, 54, and 99 or 103.

In some embodiments of any of the aspects, the component ii polypeptide (e.g., of the reader CAR system) as described herein is encoded by a nucleic acid sequence comprising SEQ ID NOs: 72, 73, 20, 21, and 75, or SEQ ID NOs: 72, 73, 20, 21, and 79, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to a sequence comprising SEQ ID NOs: 72, 73, 20, 21, and 75, or SEQ ID NOs: 72, 73, 20, 21, and 79, that maintains the same function or a codon-optimized version thereof. In some embodiments of any of the aspects, the component ii polypeptide (e.g., of the reader CAR system) as described herein is encoded by a nucleic acid sequence comprising SEQ ID NOs: 72, 73, 20, 21, and 75, or SEQ ID NOs: 72, 73, 20, 21, and 79, or a sequence that is at least 95% identical to a sequence comprising SEQ ID NOs: 72, 73, 20, 21, and 75, or SEQ ID NOs: 72, 73, 20, 21, and 79.

In some embodiments of any of the aspects, the component ii polypeptide (e.g., of the reader CAR system) comprises SEQ ID NO: 87 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 87 that maintains the same functions as SEQ ID NO: 87 (e.g., CD3zeta signaling, etc.). In some embodiments of any of the aspects, the component ii polypeptide (e.g., of the reader CAR system) comprises SEQ ID NO: 87 or an amino acid sequence that is at least 95% identical to the sequence of SEQ ID NO: 87 that maintains the same functions as SEQ ID NO: 87 (e.g., CD3zeta signaling, etc.).

In some embodiments of any of the aspects, the component ii polypeptide (e.g., of the reader CAR system) is encoded by a nucleic acid sequence comprising SEQ ID NO: 63 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 63 that maintains the same function or a codon-optimized version of SEQ ID NO: 63. In some embodiments of any of the aspects, the component ii polypeptide (e.g., of the reader CAR system) is encoded by a nucleic acid sequence comprising SEQ ID NO: 63 or a sequence that is at least 95% identical to SEQ ID NO: 63 that maintains the same function.

In some embodiments of any of the aspects, the second polypeptide (e.g., of the reader CAR system) is referred to as "component iii." In some embodiments of any of the aspects, the component iii polypeptide (e.g., of the reader CAR system) comprises from the N-terminus to the C-terminus: (a) an extracellular domain (e.g., SEQ ID NO: 72, 96); (b) a transmembrane domain (e.g., SEQ ID NO: 73, 97); (c) a repressible protease (e.g., SEQ ID NO: 75, 79, 99, 103); and (d) at least one intracellular signaling domain. In some embodiments of any of the aspects, the component iii polypeptide (e.g., of the reader CAR system) comprises from the N-terminus to the C-terminus: (a) an extracellular domain (e.g., SEQ ID NO: 72, 96); (b) a transmembrane domain (e.g., SEQ ID NO: 73, 97); (c) a repressible protease (e.g., SEQ ID NO: 75, 79, 99, 103); and (d) a single intracellular signaling domain. In some embodiments of any of the aspects, the single intracellular signalling domain of component iii (e.g., of the second reader CAR polypeptide) comprises the intracellular signaling domain of CD3zeta (e.g., SEQ ID NO: 21, 54).

In some embodiments of any of the aspects, the component iii polypeptide (e.g., of the reader CAR system) comprises SEQ ID NO: 88 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 88 that maintains the same functions as SEQ ID NO: 88 (e.g., CD3zeta signaling, etc.). In some embodiments of any of the aspects, the component iii polypeptide (e.g., of the reader CAR system) comprises SEQ ID NO: 88 or an amino acid sequence that is at least 95% identical to the sequence of SEQ ID NO: 88 that maintains the same functions as SEQ ID NO: 88 (e.g., CD3zeta signaling, etc.).

In some embodiments of any of the aspects, the component iii polypeptide (e.g., of the reader CAR system) is encoded by a nucleic acid sequence comprising SEQ ID NO: 64 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 64 that maintains the same function or a codon-optimized version of SEQ ID NO: 64. In some embodiments of any of the aspects, the component iii polypeptide (e.g., of the reader CAR system) is encoded by a nucleic acid sequence comprising SEQ ID NO: 64 or a sequence that is at least 95% identical to SEQ ID NO: 64 that maintains the same function.

In some embodiments of any of the aspects, the component iv polypeptide (e.g., of the reader CAR system) comprises from the N-terminus to the C-terminus: (a) an extracellular domain (e.g., SEQ ID NO: 72, 96); (b) a transmembrane domain (e.g., SEQ ID NO: 73, 97); (c) a single intracellular signaling domain; and (d) a repressible protease (e.g., SEQ ID NO: 75, 79, 99, 103). In some embodiments of any of the aspects, the single intracellular signalling domain of component iv (e.g., of the second reader CAR polypeptide) comprises the intracellular signaling domain of CD3zeta (e.g., SEQ ID NO: 21, 54).

In some embodiments of any of the aspects, the component iv polypeptide (e.g., of the reader CAR system) comprises SEQ ID NO: 89 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 89 that maintains the same functions as SEQ ID NO: 89 (e.g., CD3zeta signaling, etc.). In some embodiments of any of the aspects, the component iv polypeptide (e.g., of the reader CAR system) comprises SEQ ID NO: 89 or an amino acid sequence that is at least 95% identical to the sequence of SEQ ID NO: 89 that maintains the same function.

In some embodiments of any of the aspects, the component iv polypeptide (e.g., of the reader CAR system) is encoded by a nucleic acid sequence comprising SEQ ID NO: 65 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 65 that maintains the same function or a codon-optimized version of SEQ ID NO: 65. In some embodiments of any of the aspects, the component iv polypeptide (e.g., of the reader CAR system) is encoded by a nucleic acid sequence comprising SEQ ID NO: 65 or a sequence that is at least 95% identical to SEQ ID NO: 65 that maintains the same function.

In some embodiments of any of the aspects, the component iii polypeptide or component iv polypeptide (e.g., of the reader CAR system) as described herein comprises SEQ ID NOs: 96, 97, 99, 54, and 99, or SEQ ID NOs: 96, 97, 54, and 103, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to a sequence comprising SEQ ID NOs: 96, 97, 54, and 99, or SEQ ID NOs: 96, 97, 54, and 103, that maintains the same functions as SEQ ID NOs: 96, 97, 54, and 99 or 103. In some embodiments of any of the aspects, the component iii polypeptide or component iv polypeptide (e.g., of the reader CAR system) as described herein comprises SEQ ID NOs: 96, 97, 99, 54, and 99, or SEQ ID NOs: 96, 97, 54, and 103, or an amino acid sequence that is at least 95% identical to a sequence comprising SEQ ID NOs: 96, 97, 54, and 99, or SEQ ID NOs: 96, 97, 54, and 103, that maintains the same functions as SEQ ID NOs: 96, 97, 54, and 99 or 103.

In some embodiments of any of the aspects, the component iii polypeptide or component iv polypeptide (e.g., of the reader CAR system) as described herein is encoded by a nucleic acid sequence comprising SEQ ID NOs: 72, 73, 21, and 75, or SEQ ID NOs: 72, 73, 21, and 79, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to a sequence comprising SEQ ID NOs: 72, 73, 21, and 75, or SEQ ID NOs: 72, 73, 21, and 79, that maintains the same function or a codon-optimized version thereof. In some embodiments of any of the aspects, the component iii polypeptide or component iv polypeptide (e.g., of the reader CAR system) as described herein is encoded by a nucleic acid sequence comprising SEQ ID NOs: 72, 73, 21, and 75, or SEQ ID NOs: 72, 73, 21, and 79, or a sequence that is at least 95% identical to a sequence comprising SEQ ID NOs: 72, 73, 21, and 75, or SEQ ID NOs: 72, 73, 21, and 79, that maintains the same function or a codon-optimized version thereof.

In some embodiments of any of the aspects, the extracellular domain (e.g., of the second reader CAR system polypeptide) comprises the extracellular domain of DAP10. In some embodiments of any of the aspects, the extracellular domain (e.g., of the second reader CAR system polypeptide) is another extracellular domain as described herein. In some embodiments of any of the aspects, the second reader CAR system polypeptide does not comprise an extracellular binding domain.

In some embodiments of any of the aspects, the transmembrane domain is located between the extracellular domain and the at least one intracellular signaling domain. The transmembrane domain of the second reader CAR polypeptide can be any known transmembrane domain. In one embodiment, the transmembrane domain of the second reader CAR polypeptide comprises the transmembrane domain of CD8.

In some embodiments of any of the aspects, the second reader CAR polypeptide comprises 1, 2, 3, 4, 5, or more intracellular signaling domains. In embodiments comprising multiple intracellular signaling domains, the multiple repressible proteases can be different individual intracellular signaling domains or multiple copies of the same intracellular signaling domain, or a combination of the foregoing. In some embodiments of any of the aspects, the intracellular signaling domain (e.g., of the second reader CAR polypeptide) comprises at least one intracellular signaling domain selected from the group consisting of: TCRC; FcRy; FcRp; CD3zeta; CD3y; CD3ς; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-L1); CD278 (ICOS); DAP10; LAT; KD2C SLP76; TRIM; ZAP70; and 41BB. In some embodiments of any of the aspects, the second reader CAR polypeptide comprises the intracellular signaling domain of 4-1BB and/or CD3zeta.

In some embodiments of any of the aspects, the second reader CAR polypeptide further comprises at least one detectable marker as described further herein. In some embodiments of any of the aspects, the detectable marker (e.g., of the second reader CAR polypeptide) is located at the C-terminal end of the polypeptide. In some embodiments of any of the aspects, the detectable marker (e.g., of the second reader CAR polypeptide) is selected from GFP, V5, HA1, Myc, VSV-G, HSV, FLAG, HIS, AU1, mCherry, and biotin.

In one aspect, described herein is a reader CAR system comprising the first and second reader polypeptides as described herein. Accordingly, the reader CAR system comprises: (a) a first polypeptide comprising: (i) an extracellular binding domain; (ii) a transmembrane domain; (iii) at least one intracellular signaling domain; and (iv) a reader domain; and (b) a second polypeptide comprising: (i) an extracellular domain; (ii) a transmembrane domain; (iii) a repressible protease; and (iv) at least one intracellular signaling domain; see e.g., Tables 5 and 9.

In some embodiments of any of the aspects, the second polypeptide (e.g., of the reader CAR system) specifically binds to the first polypeptide (e.g., of the reader CAR system) in the presence of protease inhibitor specific for both the reader domain of the first reader CAR polypeptide and the repressible protease of the second reader CAR polypeptide. In some embodiments of any of the aspects, the second polypeptide (e.g., of the reader CAR system) does not bind to the first polypeptide (e.g., of the reader CAR system) in the absence of the specific protease inhibitor. In some embodiments of any of the aspects, the reader CAR system is active (e.g., results in intracellular signaling when the extracellular binding domain binds its specific antigen) in the presence of the specific protease inhibitor. In some embodiments of any of the aspects, the reader CAR system is inactive (e.g., does not result in intracellular signaling) in the absence of the specific protease inhibitor, even when the extracellular binding domain binds its specific antigen or in the presence of another protease inhibitor that does not bind to the reader domain.

As a non-limiting example, grazoprevir in combination with the second reader CAR polypeptide can bind to a first reader CAR polypeptide comprising a GNCR reader domain, but not to a first reader CAR polypeptide comprising a DNCR reader domain. As another non-limiting example, danoprevir in combination with the second reader CAR polypeptide can bind to a first reader CAR polypeptide comprising a DNCR reader domain, but not to a first reader CAR polypeptide comprising a GNCR reader domain.

As such, in one aspect described herein is a reader CAR system (i.e., a multi-component reader CAR system) comprising multiple (e.g., 2, 3, 4, 5, or more) first reader CAR polypeptides, each comprising a different reader domain, and a second reader CAR polypeptide that can bind to each first reader CAR polypeptide depending on the presence of protease inhibitor specific to each reader domain. Accordingly, a three-component reader CAR system can comprise: (a) a first polypeptide comprising: (i) a first extracellular binding domain; (ii) a transmembrane domain; (iii) at least one intracellular signaling domain; and (iv) a first reader domain; (b) a second polypeptide comprising: (i) a second extracellular binding domain; (ii) a transmembrane domain;

(iii) at least one intracellular signaling domain; and (iv) a second reader domain; and (c) a third polypeptide comprising: (i) an extracellular domain; (ii) a transmembrane domain; (iii) a repressible protease; and (iv) at least one intracellular signaling domain. In some embodiments of any of the aspects, the first and second reader domains can comprise any different reader domains that are responsive to different protease inhibitors. As a non-limiting example, the first reader domain can comprise DNCR and the second reader domain can comprise GNCR.

In some embodiments of any of the aspects, the extracellular binding domain of the first reader CAR polypeptide (e.g., of the three-component reader CAR system) binds to a tumor antigen that is different than the tumor antigen that binds to the extracellular binding domain of the second reader CAR polypeptide (e.g., of the three-component reader CAR system). Accordingly, the activity of the system and the antigen against which the system is directed depends on which protease inhibitor is present.

In some embodiments of any of the aspects, the three-component reader CAR system is active against the antigen of the first extracellular binding domain (e.g., results in intracellular signaling) in the presence of the protease inhibitor specific for the first reader domain. In some embodiments of any of the aspects, the three-component reader CAR system is active against the antigen of the second extracellular binding domain (e.g., results in intracellular signaling) in the presence of the protease inhibitor specific for the second reader domain. In some embodiments of any of the aspects, the three-component reader CAR system is active against the antigen of both the first and second extracellular binding domains (e.g., results in intracellular signaling) in the presence of the protease inhibitors specific for the first and second reader domains.

In some embodiments of any of the aspects, the first reader CAR polypeptide does not comprise an intracellular signalling domain. Accordingly, the reader CAR system can comprise: (a) a first polypeptide comprising: (i) an extracellular binding domain; (ii) a transmembrane domain; and (iii) a reader domain; and (b) a second polypeptide comprising: (i) an extracellular domain; (ii) a transmembrane domain; (iii) a repressible protease; and (iv) at least one intracellular signaling domain.

In some embodiments of any of the aspects, the second reader CAR polypeptide does not comprise an extracellular domain or a transmembrane domain, and it is a cytoplasmic protein. Accordingly, the reader CAR system can comprise: (a) a first polypeptide comprising: (i) an extracellular binding domain; (ii) a transmembrane domain; (iii) at least one intracellular signaling domain; and (iv) a reader domain; and (b) a second polypeptide comprising: (i) a repressible protease; and (ii) at least one intracellular signaling domain.

Figure 11A:
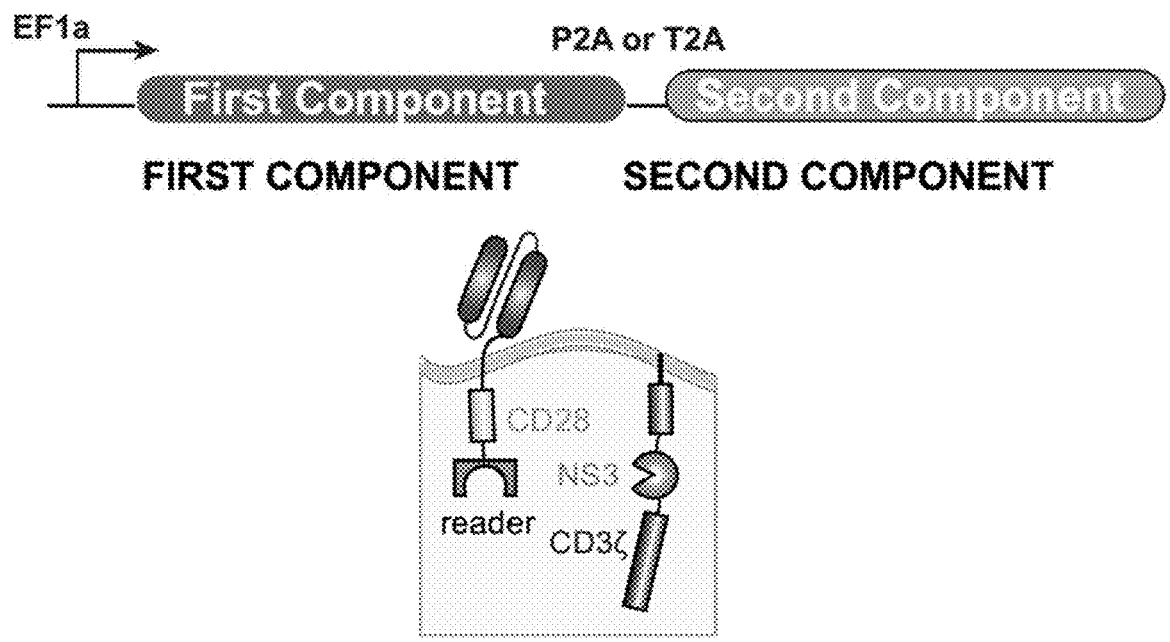
FIG. 11A-11C is a series of schematics and graphs showing testing of NS3 Reader CARs in Jurkat T cells.
Figure 11B:
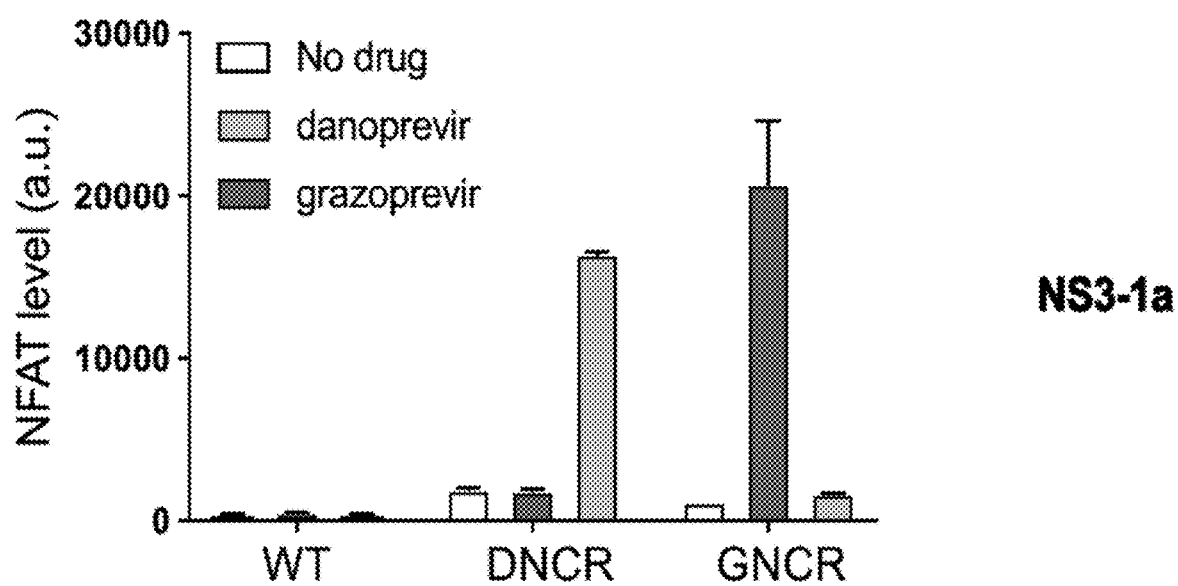
Figure 11C:
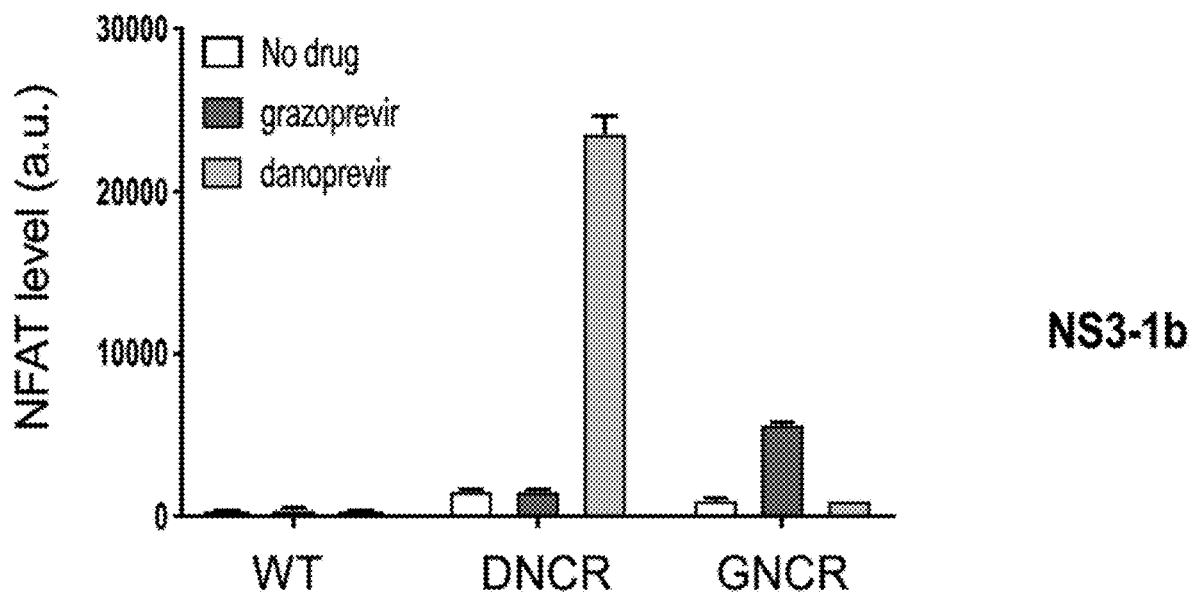

In some embodiments of any of the aspects, a specific genotype of NS3 repressible protease is paired with a specific reader domain (see e.g., FIG. 11B-11C). In one embodiment, a reader CAR system comprises a first polypeptide comprising a DNCR domain (e.g., SEQ ID NO: 77, 101) and a second polypeptide comprising NS3 genotype 1A (e.g., SEQ ID NO: 79, 103); see e.g., FIG. 11B, Table 8, and SEQ ID NO: 66, 67, 89, and 91. In one embodiment, a reader CAR system comprises a first polypeptide comprising a DNCR domain (e.g., SEQ ID NO: 77, 101) and a second polypeptide comprising NS3 genotype 1B (e.g., SEQ ID NO: 75, 99); see e.g., FIG. 11C, Table 8, and SEQ ID NO: 125 and 127. In one embodiment, a reader CAR system comprises a first polypeptide comprising a GNCR domain (e.g., SEQ ID NO: 81, 105) and a second polypeptide comprising NS3 genotype 1A (e.g., SEQ ID NO: 79, 103); see e.g., FIG. 11B, Table 9, and SEQ ID NO: 58, 69, 92, and 93. In one embodiment, a reader CAR system comprises a first polypeptide comprising a GNCR domain (e.g., SEQ ID NO: 81, 105) and a second polypeptide comprising NS3 genotype 1B (e.g., SEQ ID NO: 75, 99); see e.g., FIG. 11C, Table 9, and SEQ ID NO: 126 and 128.

In some embodiments of any of the aspects, a first reader CAR polypeptide comprises a reader domain comprising SEQ ID NO: 101 or SEQ ID NO: 105 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NOs: 101 or 105 that maintains the same function; and a second reader CAR polypeptide comprises a repressible protease comprising SEQ ID NO: 99 or 103 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NOs: 99 or 103 that maintains the same function.

In some embodiments of any of the aspects, a first reader CAR polypeptide comprises a reader domain encoded by a nucleic acid sequence comprising SEQ ID NOs: 77 or 81, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NOs: 77 or 81 that maintains the same function or a codon-optimized version thereof; and a second reader CAR polypeptide comprises a repressible protease encoded by a nucleic acid sequence comprising SEQ ID NOs: 75 or 79, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NOs: 75 or 79 that maintains the same function or a codon-optimized version thereof.

In some embodiments of any of the aspects, one polypeptide of the reader CAR system comprises a reader domain, and the other polypeptide of the reader CAR system comprises a repressible protease that binds to the reader domain, in the presence of a specific protease inhibitor. In some embodiments of any of the aspects, one polypeptide of the reader CAR system comprises an intracellular signaling domain, and the other polypeptide of the reader CAR system comprises an intracellular signaling domain that is a co-stimulatory domain. In some embodiments of any of the aspects, one polypeptide of the reader CAR system comprises an extracellular binding domain, and the other polypeptide of the reader CAR system comprises an extracellular domain (e.g., extracellular domain of DAP10) but does not comprise an extracellular binding domain. The reader CAR system can comprise any combination and assortment of reader domain, repressible protease, extracellular domain, signaling domain, and co-stimulatory domain between the two polypeptides (see e.g., Table 11 for non-limiting examples).

In some embodiments of any of the aspects, the first polypeptide (e.g., of the reader CAR system) comprises a co-stimulatory signaling domain. In some embodiments of any of the aspects, the co-stimulatory signaling domain of the first polypeptide (e.g., of the reader CAR system) comprises the co-stimulatory signaling domain of CD28. In some embodiments of any of the aspects, the co-stimulatory signaling domain of the first polypeptide (e.g., of the reader CAR system) comprises the co-stimulatory signaling domain of 4-1BB.

In some embodiments of any of the aspects, the second polypeptide (e.g., of the reader CAR system) comprises a signaling domain. In some embodiments of any of the aspects, the co-stimulatory signaling domain of the second polypeptide (e.g., of the reader CAR system) comprises the signaling domain of CD3zeta. In some embodiments of any of the aspects, the second polypeptide (e.g., of the reader CAR system) further comprises a co-stimulatory signaling domain. In some embodiments of any of the aspects, the co-stimulatory signaling domain of the second polypeptide (e.g., of the reader CAR system) comprises the co-stimulatory signaling domain of 4-1BB.

In some embodiments of any of the aspects, both polypeptides of the reader CAR system comprise an extracellular binding domain. In some embodiments of any of the aspects, the extracellular binding domain of the first reader CAR polypeptide binds to a tumor antigen that is the same as the tumor antigen that binds to the extracellular binding domain of the second reader CAR polypeptide. In some embodiments of any of the aspects, the extracellular binding domain of the first reader CAR polypeptide binds to a tumor antigen that is different than the tumor antigen that binds to the extracellular binding domain of the second reader CAR polypeptide. In some embodiments of any of the aspects, the extracellular binding domain of the first reader CAR polypeptide binds to a tumor antigen that is different than but found in close proximity to (e.g., on the same tumor cell) the tumor antigen that binds to the extracellular binding domain of the second reader CAR polypeptide. In some embodiments of any of the aspects, the reader CAR system is not functional (e.g., result in intracellular signaling) unless both antigens of the first and second reader CAR polypeptides are present in close proximity (e.g., on the same tumor cell).

TABLE 11

Exemplary combinations of domains in the first (1st) and second (2nd) polypeptides of the reader CAR system.

| | EBD | Read | Pro. | CD3z | CD28 | 41BB |
|---|---|---|---|---|---|---|
| 1st | x | x | | | x | |
| 2nd | | | x | x | | |
| 1st | x | x | | | x | x |
| 2nd | | | x | x | | |
| 1st | x | x | | | x | |
| 2nd | | | x | x | | x |
| 1st | x | x | | | x | x |
| 2nd | | | x | x | | x |
| 1st | x | | | x | x | |
| 2nd | | x | | x | | |
| 1st | x | | x | | x | x |
| 2nd | | x | | x | | |
| 1st | x | | x | | x | |
| 2nd | | x | | x | | x |
| 1st | x | | x | | x | x |
| 2nd | | x | | x | | x |
| 1st | | x | | x | | |
| 2nd | x | | x | x | | |
| 1st | | x | | x | | x |
| 2nd | x | | x | x | | |
| 1st | | x | | | x | |
| 2nd | x | | x | x | | |
| 1st | | x | | x | x | x |
| 2nd | x | x | x | | | |
| 1st | x | x | | | x | x |
| 2nd | x | x | | x | | |
| 1st | x | x | | x | | x |
| 2nd | x | x | | x | | x |
| 1st | x | x | | | x | x |
| 2nd | x | x | | x | x | |
| 1st | x | x | x | | x | |
| 2nd | x | | x | x | | |
| 1st | x | x | | | x | x |
| 2nd | x | x | | x | | x |
| 1st | x | x | | x | | |
| 2nd | x | x | | x | | |
| 1st | x | x | | x | x | |
| 2nd | x | x | | x | | x |
| 1st | x | x | | x | x | x |
| 2nd | x | x | | x | | x |
| 1st | x | x | | x | x | x |
| 2nd | | x | | x | x | |
| 1st | x | x | | | x | x |
| 2nd | | | x | | | x |
| 1st | x | x | | | | x |
| 2nd | | | x | x | x | x |
| 1st | x | x | | x | x | x |
| 2nd | | | x | | | x |
| 1st | x | | | | | x |
| 2nd | | x | | x | x | x |
| 1st | x | | x | | x | x |
| 2nd | | | x | | | x |
| 1st | x | | | | | x |
| 2nd | | x | | x | x | x |
| 1st | x | | x | x | x | x |
| 2nd | | x | | | | x |
| 1st | | x | | | | x |
| 2nd | x | | x | x | x | x |
| 1st | | x | | x | x | x |
| 2nd | x | x | | | | x |
| 1st | | x | | x | x | |
| 2nd | x | | x | | | x |
| 1st | | x | x | x | x | x |
| 2nd | x | | | | | x |
| 1st | | x | | x | x | x |
| 2nd | x | x | x | | | x |
| 1st | | x | | x | x | |
| 2nd | x | | x | | | x |
| 1st | | x | | x | x | x |
| 2nd | x | x | | | | x |
| 1st | x | x | | | | x |
| 2nd | | | x | x | x | |
| 1st | x | x | | x | x | |
| 2nd | | x | | | | x |
| 1st | x | x | | x | x | x |
| 2nd | | x | x | | | x |
| 1st | x | x | | x | x | |
| 2nd | | x | x | | | x |
| 1st | x | | | x | x | x |
| 2nd | | x | x | | | x |
| 1st | x | x | | | | x |
| 2nd | x | x | | x | x | |
| 1st | x | x | | x | x | x |
| 2nd | | x | x | | | x |
| 1st | x | | x | | | x |
| 2nd | | x | x | | | |
| 1st | x | x | | | | x |
| 2nd | | x | | x | x | |

TABLE 11-continued

Exemplary combinations of domains in the first (1st) and second (2nd) polypeptides of the reader CAR system.

| | EBD | Read | Pro. | CD3z | CD28 | 41BB |
|---|---|---|---|---|---|---|
| 1st | x | x | | | | |
| 2nd | | | x | x | x | x |
| 1st | x | | x | | | |
| 2nd | | x | | x | | |
| 1st | x | | x | | | |
| 2nd | | x | | x | x | |
| 1st | x | | x | | | |
| 2nd | | x | | x | | x |
| 1st | x | | x | | | |
| 2nd | | x | | x | x | x |

"EBD" indicates extracellular binding domain; where an EBD is not indicated, then an extracellular domain (e.g., DAP10 extracellular domain) can be present or the polypeptide can be a cytosolic protein.
"Read" indicates the reader domain.
"Pro." indicates the repressible protease. The domains shown in Table 11 are not necessarily shown in sequential order. Each polypeptide in Table 11 can further comprise a transmembrane domain.

In some embodiments of any of the aspects, the first polypeptide and second polypeptide (e.g., of the reader CAR system) are in the same contiguous molecule. In some embodiments of any of the aspects, the first polypeptide (e.g., of the reader CAR system) is N-terminal of the second polypeptide. In some embodiments of any of the aspects, the second polypeptide (e.g., of the reader CAR system) is N-terminal of the first polypeptide.

In some embodiments of any of the aspects, the first polypeptide and second polypeptide (e.g., of the reader CAR system) flank a self-cleaving peptide domain. In some embodiments of any of the aspects, the self-cleaving peptide is T2A, P2A, or another self-cleaving peptide as described herein. The self-cleaving peptide allows the nucleic acids of the first polypeptide and second polypeptide (e.g., of the reader CAR system) to be present in the same vector, but after translation the self-cleaving peptide cleaves the translated polypeptide into two separate polypeptides.

In some embodiments of any of the aspects, the reader CAR polypeptide system comprises SEQ ID NO: 90, 91, 92, 93, 127, 128, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 89, 91, 92, 93, 127, or 128 that maintains the same functions as SEQ ID NOs: 90, 91, 92, 93, 127, or 128 (e.g., target cell binding, CD3zeta signaling, etc.). In some embodiments of any of the aspects, the reader CAR polypeptide system comprises SEQ ID NOs: 89, 91, 92, 93, 127, 128, or an amino acid sequence that is at least 95% identical to the sequence of one of SEQ ID NOs: 90, 91, 92, 93, 127, or 128 that maintains the same function.

In some embodiments of any of the aspects, the reader CAR polypeptide system is encoded by a nucleic acid sequence comprising SEQ ID NOs: 66, 67, 68, 69, 125, or 126 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to one of SEQ ID NOs: 66-69 or 125-126 that maintains the same function or a codon-optimized version of SEQ ID NOs: 66-69 or 125-126. In some embodiments of any of the aspects, the reader CAR polypeptide system is encoded by a nucleic acid sequence comprising SEQ ID NOs: 66, 67, 68, 69, 125, or 126 or a sequence that is at least 95% identical to one of SEQ ID NOs: 66-69 or 125-126 that maintains the same function.

In some embodiments, the first polypeptide of the reader CAR system is encoded by a nucleic acid sequence comprising nt 1-1881 of SEQ ID NO: 66 or a sequence that is at least 95% identical that maintains the same function. In some embodiments, the second polypeptide of the reader CAR system is encoded by a nucleic acid sequence comprising nt 1945-3942 of SEQ ID NO: 66 or a sequence that is at least 95% identical that maintains the same function.

In some embodiments, the first polypeptide of the reader CAR system is encoded by a nucleic acid sequence comprising nt 1-1881 of SEQ ID NO: 125 or a sequence that is at least 95% identical that maintains the same function. In some embodiments, the second polypeptide of the reader CAR system is encoded by a nucleic acid sequence comprising nt 1945-3915 of SEQ ID NO: 125 or a sequence that is at least 95% identical that maintains the same function.

In some embodiments, the first polypeptide of the reader CAR system is encoded by a nucleic acid sequence comprising nt 1-2007 of SEQ ID NO: 67 or a sequence that is at least 95% identical that maintains the same function. In some embodiments, the second polypeptide of the reader CAR system is encoded by a nucleic acid sequence comprising nt 2071-4071 of SEQ ID NO: 67 or a sequence that is at least 95% identical that maintains the same function.

In some embodiments, the first polypeptide of the reader CAR system is encoded by a nucleic acid sequence comprising nt 1-1893 of SEQ ID NO: 68 or a sequence that is at least 95% identical that maintains the same function. In some embodiments, the second polypeptide of the reader CAR system is encoded by a nucleic acid sequence comprising nt 1957-3954 of SEQ ID NO: 68 or a sequence that is at least 95% identical that maintains the same function.

In some embodiments, the first polypeptide of the reader CAR system is encoded by a nucleic acid sequence comprising nt 1-1893 of SEQ ID NO: 126 or a sequence that is at least 95% identical that maintains the same function. In some embodiments, the second polypeptide of the reader CAR system is encoded by a nucleic acid sequence comprising nt 1957-3927 of SEQ ID NO: 126 or a sequence that is at least 95% identical that maintains the same function.

In some embodiments, the first polypeptide of the reader CAR system is encoded by a nucleic acid sequence comprising nt 1-2019 of SEQ ID NO: 69 or a sequence that is at least 95% identical that maintains the same function. In some embodiments, the second polypeptide of the reader CAR system is encoded by a nucleic acid sequence comprising nt 2083-4083 of SEQ ID NO: 69 or a sequence that is at least 95% identical that maintains the same function.

In some embodiments, the first polypeptide of the reader CAR system comprises aa 1-626 of SEQ ID NO: 90 or a sequence that is at least 95% identical that maintains the same function. In some embodiments, the second polypeptide of the reader CAR system comprises aa 648-1313 of SEQ ID NO: 90 or a sequence that is at least 95% identical that maintains the same function.

In some embodiments, the first polypeptide of the reader CAR system comprises aa 1-626 of SEQ ID NO: 127 or a sequence that is at least 95% identical that maintains the same function. In some embodiments, the second polypeptide of the reader CAR system comprises aa 648-1303 of SEQ ID NO: 127 or a sequence that is at least 95% identical that maintains the same function.

In some embodiments, the first polypeptide of the reader CAR system comprises aa 1-668 of SEQ ID NO: 91 or a sequence that is at least 95% identical that maintains the same function. In some embodiments, the second polypeptide of the reader CAR system comprises aa 690-1355 of SEQ ID NO: 91 or a sequence that is at least 95% identical that maintains the same function.

In some embodiments, the first polypeptide of the reader CAR system comprises aa 1-630 of SEQ ID NO: 92 or a sequence that is at least 95% identical that maintains the same function. In some embodiments, the second polypeptide of the reader CAR system comprises aa 652-1317 of SEQ ID NO: 92 or a sequence that is at least 95% identical that maintains the same function.

In some embodiments, the first polypeptide of the reader CAR system comprises aa 1-630 of SEQ ID NO: 128 or a sequence that is at least 95% identical that maintains the same function. In some embodiments, the second polypeptide of the reader CAR system comprises aa 652-1307 of SEQ ID NO: 128 or a sequence that is at least 95% identical that maintains the same function.

In some embodiments, the first polypeptide of the reader CAR system comprises aa 1-672 of SEQ ID NO: 93 or a sequence that is at least 95% identical that maintains the same function. In some embodiments, the second polypeptide of the reader CAR system comprises aa 694-1359 of SEQ ID NO: 93 or a sequence that is at least 95% identical that maintains the same function.

Tables 5 and 9 shows the locations of specific domains in exemplary Reader CAR sequences. The nucleic acid numbers are shown first, followed by the amino acid residues.

TABLE 5

Reader CAR Sequences (DNCR)

| Element (SEQ ID NOs) | DNCR CAR ciii (SEQ ID NO: 66, 90) | DNCR CAR NS31b (SEQ ID NO: 125, 127) | DNCR CAR diii (SEQ ID NO: 67, 91) |
| --- | --- | --- | --- |
| CD8a leading peptide (7, 40) | 1-63, 1-20 | 1-63, 1-20 | 1-63, 1-20 |
| CD19 scFv (70, 94) | 64-789, 21-262 | 64-789, 21-262 | 64-789, 21-262 |
| V5 tag (9, 42) | 790-831, 263-276 | 790-831, 263-276 | 790-831, 263-276 |
| CD8 hinge (10, 43) | 844-978, 281-325 | 844-978, 281-325 | 844-978, 281-325 |
| CD28 transmembrane (11, 44) | 979-1059, 326-352 | 979-1059, 326-352 | 979-1059, 326-352 |
| CD28 ICD (19, 52) | 1060-1182, 353-393 | 1060-1182, 353-393 | 1060-1182, 353-393 |
| 41BB ICD (20, 53) | | | 1183-1308, 394-435 |
| Linker (80, 104) | 1183-1194, 394-397 | 1183-1194, 394-397 | 1309-1320, 436-439 |
| DNCR2 (77, 101) | 1195-1881, 398-626 | 1195-1881, 398-626 | 1321-2007, 440-668 |
| GNCR1 (81, 105) | | | |
| T2A (78, 102) | 1882-1944, 627-647 | 1882-1944, 627-647 | 2008-2070, 669-689 |
| DAP10 ectodomain (72, 96) | 1945-2088, 648-695 | 1945-2088, 648-695 | 2071-2214, 690-737 |
| CD8 transmembrane (73, 97) | 2089-2151, 696-716 | 2089-2151, 696-716 | 2215-2277, 738-758 |
| 41BB ICD (20, 53) | 2152-2277, 717-758 | 2152-2277, 717-758 | 2278-2403, 759-800 |
| NS4A (15, 48) | 2278-2316, 759-771 | 2278-2316, 759-771 | 2404-2442, 801-813 |
| NS31a (79, 103) | 2329-2895, 776-964 | | 2455-3021, 818-1006 |
| NS31b (75, 99) | | 2329-2865, 776-954 | |
| CD3z ICD (21, 54) | 2896-3231, 965-1076 | 2866-3201, 955-1066 | 3022-3357, 1007-1118 |
| mCherry (76, 100) | 3235-3942, 1078-1313 | 3205-3915, 1068-1303 | 3361-4068, 1120-1355 |

TABLE 9

Reader CAR Sequences (GNCR)

| Element (SEQ ID NOs) | GNCR CAR ciii (SEQ ID NO: 68, 92) | GNCR CAR NS31b (SEQ ID NO: 126, 128) | GNCR CAR diii (SEQ ID NO: 69, 93) |
| --- | --- | --- | --- |
| CD8a leading peptide (7, 40) | 1-63, 1-20 | 1-63, 1-20 | 1-63, 1-20 |
| CD19 scFv (70, 94) | 64-789, 21-262 | 64-789, 21-262 | 64-789, 21-262 |
| V5 tag (9, 42) | 790-831, 263-276 | 790-831, 263-276 | 790-831, 263-276 |
| CD8 hinge (10, 43) | 844-978, 281-325 | 844-978, 281-325 | 844-978, 281-325 |
| CD28 transmembrane (11, 44) | 979-1059, 326-352 | 979-1059, 326-352 | 979-1059, 326-352 |
| CD28 ICD (19, 52) | 1060-1182, 353-393 | 1060-1182, 353-393 | 1060-1182, 353-393 |
| 41BB ICD (20, 53) | | | 1183-1308, 394-435 |
| Linker (80, 104) | 1183-1194, 394-397 | 1183-1194, 394-397 | 1309-1320, 436-439 |
| DNCR2 (77, 101) | | | |
| GNCR1 (81, 105) | 1195-1893, 398-630 | 1195-1893, 398-630 | 1321-2019, 440-672 |
| T2A (78, 102) | 1894-1956, 631-651 | 1894-1956, 631-651 | 2020-2082, 673-693 |
| DAP10 ectodomain (72, 96) | 1957-2100, 652-699 | 1957-2100, 652-699 | 2083-2226, 694-741 |
| CD8 transmembrane (73, 97) | 2101-2163, 700-720 | 2101-2163, 700-720 | 2227-2289, 742-762 |
| 41BB ICD (20, 53) | 2164-22789, 721-762 | 2164-22789, 721-762 | 2290-2415, 763-804 |
| NS4A (15, 48) | 2290-2328, 763-775 | 2290-2328, 763-775 | 2416-2454, 805-817 |
| NS31a (79, 103) | 2341-2907, 780-968 | | 2467-3033, 822-1010 |
| NS31b (75, 99) | | 2341-2877, 780-958 | |
| CD3z ICD (21, 54) | 2908-3243, 969-1080 | 2878-3213, 959-1070 | 3034-3369, 1011-1122 |
| mCherry (76, 100) | 3247-3954, 1082-1317 | 3217-3927, 1072-1307 | 3373-4080, 1124-1359 |

In multiple aspects, described herein are polynucleotides that encode for CAR polypeptides or CAR polypeptide systems. In some embodiments of any of the aspects, a CAR polynucleotide comprises SEQ ID NOs: 1-6, 60-69, 106-113, 125-126 (see e.g., Table 20), or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NOs: 1-6, 60-69, 106-113, 125-126, that as a polypeptide maintains the same functions as SEQ ID NOs: 1-6, 60-69, 106-113, 125-126 (e.g., antigen-binding and intracellular signaling).

In some embodiments, the CAR polynucleotide is a codon-optimized version of SEQ ID NOs: 1-6, 60-69, 106-113, 125-126. In some embodiments of any of the aspects, the vector or nucleic acid described herein is codon-optimized, e.g., the native or wild-type sequence of the nucleic acid sequence has been altered or engineered to include alternative codons such that altered or engineered nucleic acid encodes the same polypeptide expression product as the native/wild-type sequence, but will be transcribed and/or translated at an improved efficiency in a desired expression system. In some embodiments of any of the aspects, the expression system is an organism other than the source of the native/wild-type sequence (or a cell obtained from such organism). In some embodiments of any of the aspects, the vector and/or nucleic acid sequence described herein is codon-optimized for expression in a mammal or mammalian cell, e.g., a mouse, a murine cell, or a human cell. In some embodiments of any of the aspects, the vector and/or nucleic acid sequence described herein is codon-optimized for expression in a human cell. In some embodiments of any of the aspects, the vector and/or nucleic acid sequence described herein is codon-optimized for expression in a yeast or yeast cell. In some embodiments of any of the aspects, the vector and/or nucleic acid sequence described herein is codon-optimized for expression in a bacterial cell. In some embodiments of any of the aspects, the vector and/or nucleic acid sequence described herein is codon-optimized for expression in an *E. coli* cell.

In some embodiments, one or more of the genes described herein is expressed in a recombinant expression vector or plasmid. As used herein, the term "vector" refers to a polynucleotide sequence suitable for transferring transgenes into a host cell. The term "vector" includes plasmids, mini-chromosomes, phage, naked DNA and the like. See, for example, U.S. Pat. Nos. 4,980,285; 5,631,150; 5,707,828; 5,759,828; 5,888,783 and, 5,919,670, and, Sambrook et al, Molecular Cloning: A Laboratory Manual, 2nd Ed., Cold Spring Harbor Press (1989). One type of vector is a "plasmid," which refers to a circular double stranded DNA loop into which additional DNA segments are ligated. Another type of vector is a viral vector, wherein additional DNA segments are ligated into the viral genome. Certain vectors are capable of autonomous replication in a host cell into which they are introduced (e.g., bacterial vectors having a bacterial origin of replication and episomal mammalian vectors). Moreover, certain vectors are capable of directing the expression of genes to which they are operatively linked. Such vectors are referred to herein as "expression vectors". In general, expression vectors of utility in recombinant DNA techniques are often in the form of plasmids. In the present specification, "plasmid" and "vector" is used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

A cloning vector is one which is able to replicate autonomously or integrated in the genome in a host cell, and which is further characterized by one or more endonuclease restriction sites at which the vector may be cut in a determinable fashion and into which a desired DNA sequence can be ligated such that the new recombinant vector retains its ability to replicate in the host cell. In the case of plasmids, replication of the desired sequence can occur many times as the plasmid increases in copy number within the host cell such as a host bacterium or just a single time per host before the host reproduces by mitosis. In the case of phage, replication can occur actively during a lytic phase or passively during a lysogenic phase.

An expression vector is one into which a desired DNA sequence can be inserted by restriction and ligation such that it is operably joined to regulatory sequences and can be expressed as an RNA transcript. Vectors can further contain one or more marker sequences suitable for use in the identification of cells which have or have not been transformed or transformed or transfected with the vector. Markers include, for example, genes encoding proteins which increase or decrease either resistance or sensitivity to antibiotics or other compounds, genes which encode enzymes whose activities are detectable by standard assays known in the art (e.g., β-galactosidase, luciferase or alkaline phosphatase), and genes which visibly affect the phenotype of transformed or transfected cells, hosts, colonies or plaques (e.g., green fluorescent protein). In certain embodiments, the vectors used herein are capable of autonomous replication and expression of the structural gene products present in the DNA segments to which they are operably joined.

As used herein, a coding sequence and regulatory sequences are said to be "operably" joined when they are covalently linked in such a way as to place the expression or transcription of the coding sequence under the influence or control of the regulatory sequences. If it is desired that the coding sequences be translated into a functional protein, two DNA sequences are said to be operably joined if induction of a promoter in the 5' regulatory sequences results in the transcription of the coding sequence and if the nature of the linkage between the two DNA sequences does not (1) result in the introduction of a frame-shift mutation, (2) interfere with the ability of the promoter region to direct the transcription of the coding sequences, or (3) interfere with the ability of the corresponding RNA transcript to be translated into a protein. Thus, a promoter region would be operably joined to a coding sequence if the promoter region were capable of effecting transcription of that DNA sequence such that the resulting transcript can be translated into the desired protein or polypeptide.

When the nucleic acid molecule that encodes any of the polypeptides described herein is expressed in a cell, a variety of transcription control sequences (e.g., promoter/enhancer sequences) can be used to direct its expression. The promoter can be a native promoter, i.e., the promoter of the gene in its endogenous context, which provides normal regulation of expression of the gene. In some embodiments the promoter can be constitutive, i.e., the promoter is unregulated allowing for continual transcription of its associated gene. A variety of conditional promoters also can be used, such as promoters controlled by the presence or absence of a molecule.

The precise nature of the regulatory sequences needed for gene expression can vary between species or cell types, but in general can include, as necessary, 5' non-transcribed and 5' non-translated sequences involved with the initiation of transcription and translation respectively, such as a TATA box, capping sequence, CAAT sequence, and the like. In particular, such 5' non-transcribed regulatory sequences will include a promoter region which includes a promoter sequence for transcriptional control of the operably joined gene. Regulatory sequences can also include enhancer sequences or upstream activator sequences as desired. The vectors of the invention may optionally include 5' leader or signal sequences. The choice and design of an appropriate vector is within the ability and discretion of one of ordinary skill in the art.

In some embodiments of any of the aspects, the promoter is a eukaryotic or human constitutive promoter, including but not limited to EF-1alpha, SFFV, CMV, and the like. In some embodiments of any of the aspects, the vector (e.g., SEQ ID NOs: 236-237, 250-253) comprises a human elongation factor-1 alpha (EF-1alpha) promoter (e.g., SEQ ID NO: 267), which is a constitutive promoter of human origin that can be used to drive ectopic gene expression in various in vitro and in vivo contexts. In some embodiments of any of the aspects, the vector (e.g., SEQ ID NOs: 238-249, 254-261) comprises a silencing-prone spleen focus forming virus (SFFV) promoter (e.g., SEQ ID NO: 266), which can result in a higher level of constitutive transgene expression compared with CMV or EF1α promoters. In some embodiments of any of the aspects, the vector comprises a Kozak sequence (e.g., GCCGCCACC), which is a nucleic acid motif that functions as the protein translation initiation site in eukaryotic mRNA transcripts.

Expression vectors containing all the necessary elements for expression are commercially available and known to those skilled in the art. See, e.g., Sambrook et al., *Molecular Cloning: A Laboratory Manual*, Second Edition, Cold Spring Harbor Laboratory Press, 1989. Cells are genetically engineered by the introduction into the cells of heterologous DNA (RNA). That heterologous DNA (RNA) is placed under operable control of transcriptional elements to permit the expression of the heterologous DNA in the host cell.

In some embodiments of any of the aspects, a CAR vector comprises one of SEQ ID NOs: 236-261 (see e.g., Table 20) or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 236-261, that maintains the same functions as one of SEQ ID NOs: 236-261 (e.g., lentivirus vector, CAR polypeptide expression).

In some embodiments, the vector is a pHR vector. In some embodiments, the vector is a lentiviral vector. The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. HIV, SIV, and FIV are all examples of lentiviruses. The term "lentiviral vector" refers to a vector derived from at least a portion of a lentivirus genome, including especially a self-inactivating lentiviral vector as provided in Milone et al., Mol. Ther. 17(8): 1453-1464 (2009). Other examples of lentivirus vectors that may be used in the clinic, include but are not limited to, e.g., the LENTIVECTOR® gene delivery technology from Oxford BioMedica, the LENTIMAX™ vector system from Lentigen and the like. Nonclinical types of lentiviral vectors are also available and would be known to one skilled in the art.

In some embodiments of any of the aspects, the lentiviral vector comprises a central polypurine tract (cPPT; e.g., SEQ ID NO: 268). A central polypurine tract/central termination sequence creates a "DNA flap" that increases nuclear importation of the viral genome during target-cell infection. The cPPT/CTS element improves vector integration and transduction efficiency. In some embodiments of any of the aspects, the lentiviral vector comprises a woodchuck hepatitis virus posttranscriptional regulatory element (WPRE; e.g., SEQ ID NO: 269), which prevents poly(A) site readthrough, promotes RNA processing and maturation, and increases nuclear export of RNA. In genomic transcripts, it enhances vector packaging and increases titer. In transduced target cells, the WPRE boosts transgene expression by facilitating mRNA transcript maturation.

Without limitations, the genes described herein can be included in one vector or separate vectors. For example, the first AND-gate CAR polypeptide gene and the second AND-gate CAR polypeptide gene can be included in the same vector; or the first OFF-switch CAR polypeptide gene and the second OFF-switch CAR polypeptide gene can be included in the same vector; or the first reader CAR polypeptide gene and the second reader CAR polypeptide gene can be included in the same vector.

In some embodiments, the ON-switch CAR polypeptide is included in a single vector. In some embodiments, the first AND-gate CAR polypeptide gene can be included in a first vector, and the second AND-gate CAR polypeptide gene can be included in a second vector. In some embodiments, the first OFF-switch CAR polypeptide gene can be included in a first vector, and the second OFF-switch CAR polypeptide gene can be included in a second vector. In some embodiments, the first reader CAR polypeptide gene can be included in a first vector, and the second reader CAR polypeptide gene can be included in a second vector.

In some embodiments, the vector comprises a selectable marker, e.g., for selectively amplifying the vector in bacteria. Non-limiting examples of selectable marker genes for use in bacteria include antibiotic resistance genes conferring resistance to ampicillin, tetracycline and kanamycin. The tetracycline (tet) and ampicillin (amp) resistance marker genes can be obtained from any of a number of commercially available vectors including pBR322 (available from New England BioLabs, Beverly, Mass., cat. no. 303-3s). The tet coding sequence is contained within nucleotides 86-476; the amp gene is contained within nucleotides 3295-4155. The nucleotide sequence of the kanamycin (kan) gene is available from vector pACYC 177, from New England BioLabs, Cat no. 401-L, GenBank accession No. X06402.

In some embodiments, one or more of the recombinantly expressed genes can be integrated into the genome of the cell.

A nucleic acid molecule that encodes the enzyme of the claimed invention can be introduced into a cell or cells using methods and techniques that are standard in the art. For example, nucleic acid molecules can be introduced by standard protocols such as transformation including chemical transformation and electroporation, transduction, particle bombardment, etc. Expressing the nucleic acid molecule encoding the enzymes of the claimed invention also may be accomplished by integrating the nucleic acid molecule into the genome.

TABLE 20

Exemplary CAR Polypeptide-Encoding Vectors

| SEQ ID NO | Vector Name | Corresponding CAR Polynucleotide, Polypeptide, or System |
|---|---|---|
| 236 | pHS240-ANDgate-DD | AND-Gate CAR (e.g., SEQ ID NO: 6, 39) |
| 237 | pHS241-ANDgate-NS3 | AND-Gate CAR (e.g., SEQ ID NO: 5, 38) |
| 238 | pHS340-component c | OFF-Switch CAR (e.g., SEQ ID NO: 60, 84) |
| 239 | pHS341-component d | OFF-Switch CAR (e.g., SEQ ID NO: 61, 85) |
| 240 | pHS342-component i | OFF-Switch CAR (e.g., SEQ ID NO: 62, 86) |
| 241 | pHS343-component ii | OFF-Switch CAR (e.g., SEQ ID NO: 63, 87) |
| 242 | pHS344-component iii | OFF-Switch CAR (e.g., SEQ ID NO: 64, 88) |
| 243 | pHS345-component iv | OFF-Switch CAR (e.g., SEQ ID NO: 65, 89) |
| 244 | pHS367B-DNCR CAR tethered ci - NS31b | Reader CAR (e.g., SEQ ID NO: 125, 127) |
| 245 | pHS367-DNCR CAR ciii (pHS367-DNCR CAR tethered ci - NS31a) | Reader CAR (e.g., SEQ ID NO: 66, 89) |
| 246 | pHS369-DNCR CAR diii (pHS371 - GNCR CAR tethered ci - NS31a) | Reader CAR (e.g., SEQ ID NO: 67, 91) |
| 247 | pHS371B - GNCR CAR tethered ci - NS31b | Reader CAR (e.g., SEQ ID NO: 126, 128) |
| 248 | pHS371-GNCR CAR ciii | Reader CAR (e.g., SEQ ID NO: 68, 92) |
| 249 | pHS373-GNCR CAR diii | Reader CAR (e.g., SEQ ID NO: 69, 93) |
| 250 | pNW387-NS3CAR-V1 | ON-Switch CAR (e.g., SEQ ID NO: 1, 34) |
| 251 | pNW430-Traditional CAR | Traditional CAR (e.g., SEQ ID NO: 4, 37) |
| 252 | pNW431-NS3CAR-V2 | ON-Switch CAR (e.g., SEQ ID NO: 2, 35) |
| 253 | pNW432-NS3CAR-V3 | ON-Switch CAR (e.g., SEQ ID NO: 3, 36) |
| 254 | pNW549-OFFCAR-c + i | OFF-Switch CAR (e.g., SEQ ID NO: 106, 114) |
| 255 | pNW550-OFFCAR-c + ii | OFF-Switch CAR (e.g., SEQ ID NO: 107, 115) |
| 256 | pNW551-OFFCAR-c + iii | OFF-Switch CAR (e.g., SEQ ID NO: 108, 116) |
| 257 | pNW552-OFFCAR-c + iv | OFF-Switch CAR (e.g., SEQ ID NO: 109, 117) |
| 258 | pNW553-OFFCAR-d + i | OFF-Switch CAR (e.g., SEQ ID NO: 110, 118) |
| 259 | pNW554-OFFCAR-d + ii | OFF-Switch CAR (e.g., SEQ ID NO: 111, 119) |
| 260 | pNW555-OFFCAR-d + iii | OFF-Switch CAR (e.g., SEQ ID NO: 112, 120) |
| 261 | pNW556-OFFCAR-d + iv | OFF-Switch CAR (e.g., SEQ ID NO: 113, 121) |

In some embodiments of any of the aspects, a nucleic acid primer can be used to synthesize or sequence a CAR polynucleotide or CAR vector as described herein. In some embodiments of any of the aspects, the CAR primer comprises SEQ ID NOs: 27-33, 82-83, 213-235, 262-265 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to one of SEQ ID NOs: 27-33, 82-83, 213-235, 262-265 that maintains the same function.

TABLE 19

Exemplary Primers

| SEQ ID NO | Name | Sequence |
|---|---|---|
| 27 | forward primer (e.g., for SEQ ID NO: 1-6) | ATGGCCTTACCAGTGACCG |
| 28 | primer P2R (e.g., for SEQ ID NO: 1-5) | TTAGCGAGGGGGCAGG |
| 29 | HS 401 R primer (e.g., for SEQ ID NO: 6) | CCGCTAACGCCGCAATCAGACTGATGCCGGAGCGATAGGCTGCGAAGTCGCGTGG |
| 30 | HS 402 F primer (e.g., for SEQ ID NO: 6) | ATCAGTCTGATTGCGGCGTTAGCGG |
| 31 | HS 403 R primer (e.g., for SEQ ID NO: 5) | CTGCGCTCCTGCTGAACTTCACTCTAGCGTAATCGGGCACATCGTAGGGA |
| 32 | HS 404 F primer (e.g., for SEQ ID NO: 1-5) | AGAGTGAAGTTCAGCAGGAGCGCAG |
| 33 | HS 422 R primer (e.g., for SEQ ID NOs: 236-237, 250-253) | CCTGCAGGTCGACTCTAGAGTCGCGGCCGCACTAGTTTAGCGAGGGGGCAGGGCCTGCAT |
| 82 | HS 505 R primer (e.g., for SEQ ID NO: 60) | CCTGACCCGCTGAATTCGGTACCCCCGGAGCGATAGGCTGCGAAGTCGCGT |
| 83 | HS 506 F primer (e.g., for SEQ ID NO: 60, 61, 110, 111) | GGGGGTACCGAATTCAGCGGGTCAGGC |

TABLE 19-continued

Exemplary Primers

| SEQ ID NO | Name | Sequence |
|---|---|---|
| 213 | 516F (e.g., for SEQ ID NO: 107, 111, 113) | GGTTCTGTTGTTATTGTTGGTAGAAT |
| 214 | HS519R (e.g., for SEQ ID NO: 108) | GGTAATAACCAGACTCAGCAGAAGC |
| 215 | HS520F (e.g., for SEQ ID NO: 108) | GCTTCTGCTGAGTCTGGTTATTACCGGTTCTGT TGTTATTGTTGGTAGAA |
| 216 | HS511R (e.g., for SEQ ID NO: 108) | CTGCGCTCCTGCTGAACTTCACTCTAGACCGCA TGGTAGTTTCCATAGAC |
| 217 | HS512F (e.g., for SEQ ID NO: 108) | AGAGTGAAGTTCAGCAGGAGCGCAG |
| 218 | HS521R (e.g., for SEQ ID NO: 109) | CTGCGCTCCTGCTGAACTTCACTCTGGTAATAA CCAGACTCAGCAG |
| 219 | HS515R (e.g., for SEQ ID NO: 109) | ATTCTACCAACAATAACAACAGAACCGCGAGG GGGCAGGGCCTGCATGTGA |
| 220 | HS517R (e.g., for SEQ ID NO: 109) | ATGTTATCCTCCTCGCCCTTGCTCACCATGCCA GACCGCATGGTAGTTTCCATAGAC |
| 221 | HS518F (e.g., for SEQ ID NO: 109) | ATGGTGAGCAAGGGCGAGGAGGATAACAT |
| 222 | HS 505 R primer (e.g., for SEQ ID NO: 110) | GGAGCGATAGGCTGCGAAGTCGCGT |
| 223 | HS 507 R primer (e.g., for SEQ ID NO: 110, 111) | GCCTGACCCGCTGAATTCGGTACCCCCCAGTTC ACATCCTCCTTCTTCTTCTTCT |
| 224 | HS570F (e.g. for SEQ ID NO: 125) | GGCTCAGGAAGCTCTTCCGACGAAG |
| 225 | HS571R (e.g. for SEQ ID NO: 125) | CTTCGTCGGAAGAGCTTCCTGAGCCGGAGCGA TAGGCTGCGAAGTCGCGT |
| 226 | HS572R (e.g. for SEQ ID NO: 125) | ATGATTCAGCCAACCGGATGGATCA |
| 227 | HS573F (e.g. for SEQ ID NO: 125) | TGATCCATCCGGTTGGCTGAATCATGGCAGTG GAGAGGGCAGAGGAAGTC |
| 228 | HS584R (e.g., for SEQ ID NO: 126) | GCTTCTCGATATCGCTTCCTGAGCCGGAGCGAT AGGCTGCGAAGTCGCGT |
| 229 | HS575F (e.g. for SEQ ID NO: 126) | GGCTCAGGAAGCGATATCGAGAAGC |
| 230 | HS576R (e.g. for SEQ ID NO: 126) | GGACTTACAGCGTTCTTTTACCTCC |
| 231 | HS577F (e.g. for SEQ ID NO: 126) | GGAGGTAAAAGAACGCTGTAAGTCCGGCAGTG GAGAGGGCAGAGGAAGTC |
| 232 | HS555F (e.g. for SEQ ID NO: 126) | GGCTGCGTGGTCATAGTGGGCAGGA |
| 233 | HS556R (e.g. for SEQ ID NO: 126) | CAGTTCACATCCTCCTTCTTCTTCT |
| 234 | HS580R (e.g. for SEQ ID NO: 126) | TCCTGCCCACTATGACCACGCAGCCCAGTTCA CATCCTCCTTCTTCTTCT |
| 235 | HS557F (e.g. for SEQ ID NO: 126) | AGAGTGAAGTTCAGCAGGAGCGCAG |
| 262 | 1166 Seq F (e.g., for SEQ ID NOs: 236-261) | GCTTCCCGAGCTCTATAAAAGAGC |
| 263 | Gibson Forward (e.g., for SEQ ID NOs: 236-261) | GATCTGGAGCTCTCGAGAATTCTCACGCGT |
| 264 | Gibson Reverse (e.g., for SEQ ID NOs: 236-261) | CCTGCAGGTCGACTCTAGAGTCGCGGCCGC |
| 265 | 1167 Seq R (e.g., for SEQ ID NOs: 236-261) | CCAGAGGTTGATTATCGATAAGC |

In one aspect, described herein is a cell or population thereof comprising the at least one CAR polypeptide, CAR system, CAR polynucleotide, or CAR vector as described herein (see e.g., Tables 1-5, 7-9, 20). In some embodiments of any of the aspects, the cell or population thereof can comprise any combination of CAR polypeptides or systems (see e.g., Table 12).

In one aspect, the invention provides a number of chimeric antigen receptors (CAR) comprising an antibody or antibody fragment engineered for enhanced binding to a tumor antigen. In one aspect, the invention provides a cell (e.g., T cell) engineered to express a CAR, wherein the CAR T cell ("CART") exhibits an antitumor property. In one aspect a cell is transformed with the CAR and the CAR is expressed on the cell surface. In some embodiments, the cell (e.g., T cell) is transduced with a viral vector encoding a CAR. In some embodiments, the viral vector is a retroviral vector. In some embodiments, the viral vector is a lentiviral vector. In some such embodiments, the cell may stably express the CAR. In another embodiment, the cell (e.g., T cell) is transfected with a nucleic acid, e.g., mRNA, cDNA, DNA, encoding a CAR. In some such embodiments, the cell may transiently express the CAR.

In some embodiments of any of the aspects, the cell comprises an immune cell. In some embodiments of any of the aspects, the immune cell comprises a CD4+ T cell, a CD8+ T cell, a regulatory T cell (Treg), or a natural killer (NK) cell. In one embodiment, the cell comprises a T cell. In other embodiments, the cell comprises a B cell.

In some embodiments of any of the aspects, the cells are isolated from a subject. The term "isolated" as used herein signifies that the cells are placed into conditions other than their natural environment. The term "isolated" does not preclude the later use of these cells thereafter in combinations or mixtures with other cells. In some embodiments of any of the aspects, an immune cell (e.g., T cell) is: (a) isolated from the subject; (b) genetically modified to express a CAR polypeptide or CAR system as described herein; and (c) administered to the subject. In some embodiments of any of the aspects, the cells are isolated from a first subject and administered to a second subject. In some embodiments of any of the aspects, the immune cells are first differentiated from a somatic cell sample from the subject and then genetically modified to express a CAR polypeptide or CAR system as described herein.

Figure 4A:
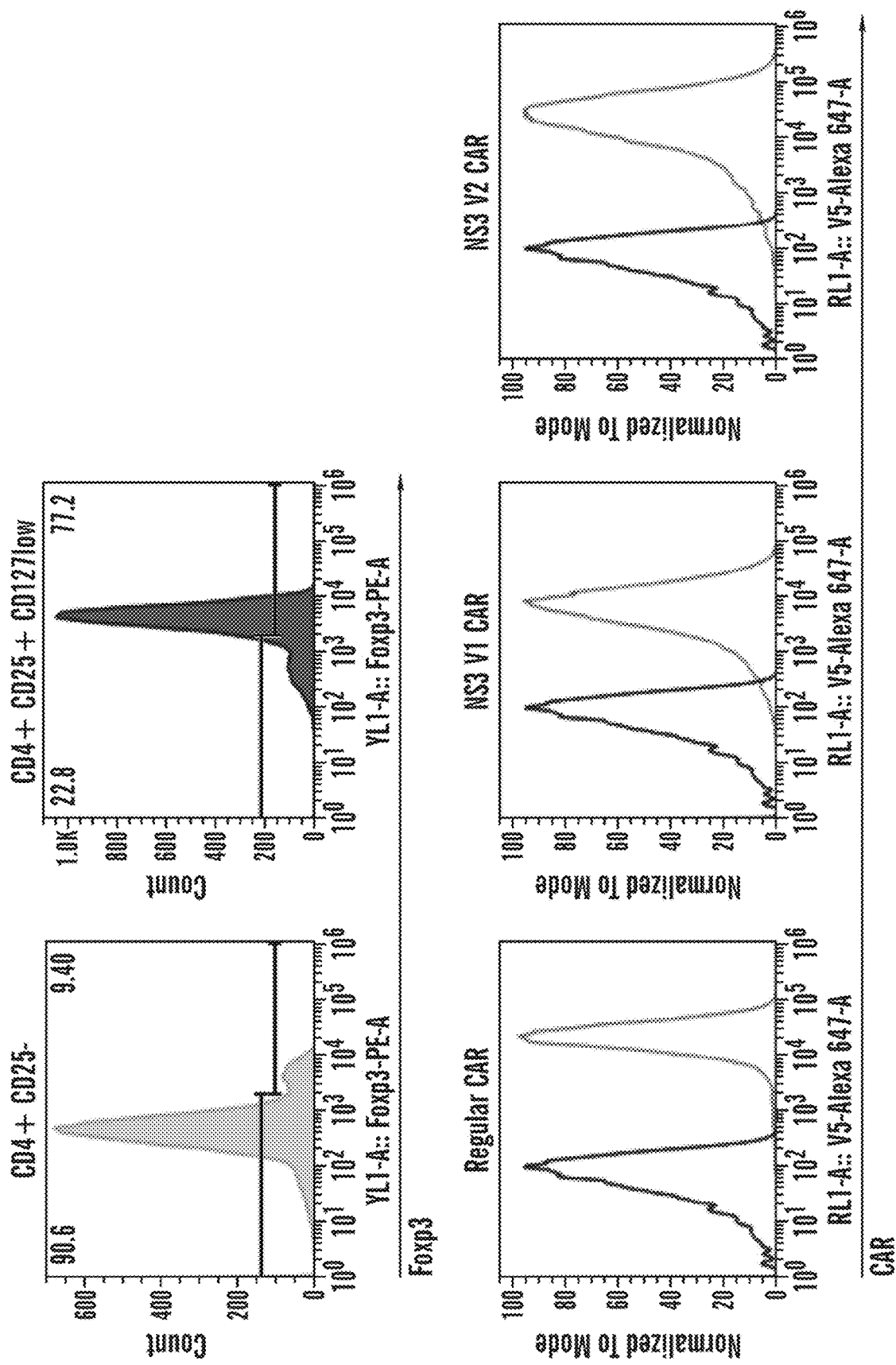
FIG. 4A-4C is a series of graphs showing the expression of V1 and V2 NS3s CARs in Tregs. The top panel of FIG. 4A shows Foxp3 expression in CD4+ CD25− Foxp3+ cells and CD4+ CD25+ CD127low Foxp3+ Tregs. The bottom panel of FIG. 4A is a series of flow cytometry histograms showing the expression of NS3 CARs in CD4+ CD25+ CD127low Foxp3+ Tregs compared to WT cells.
Figure 4B:
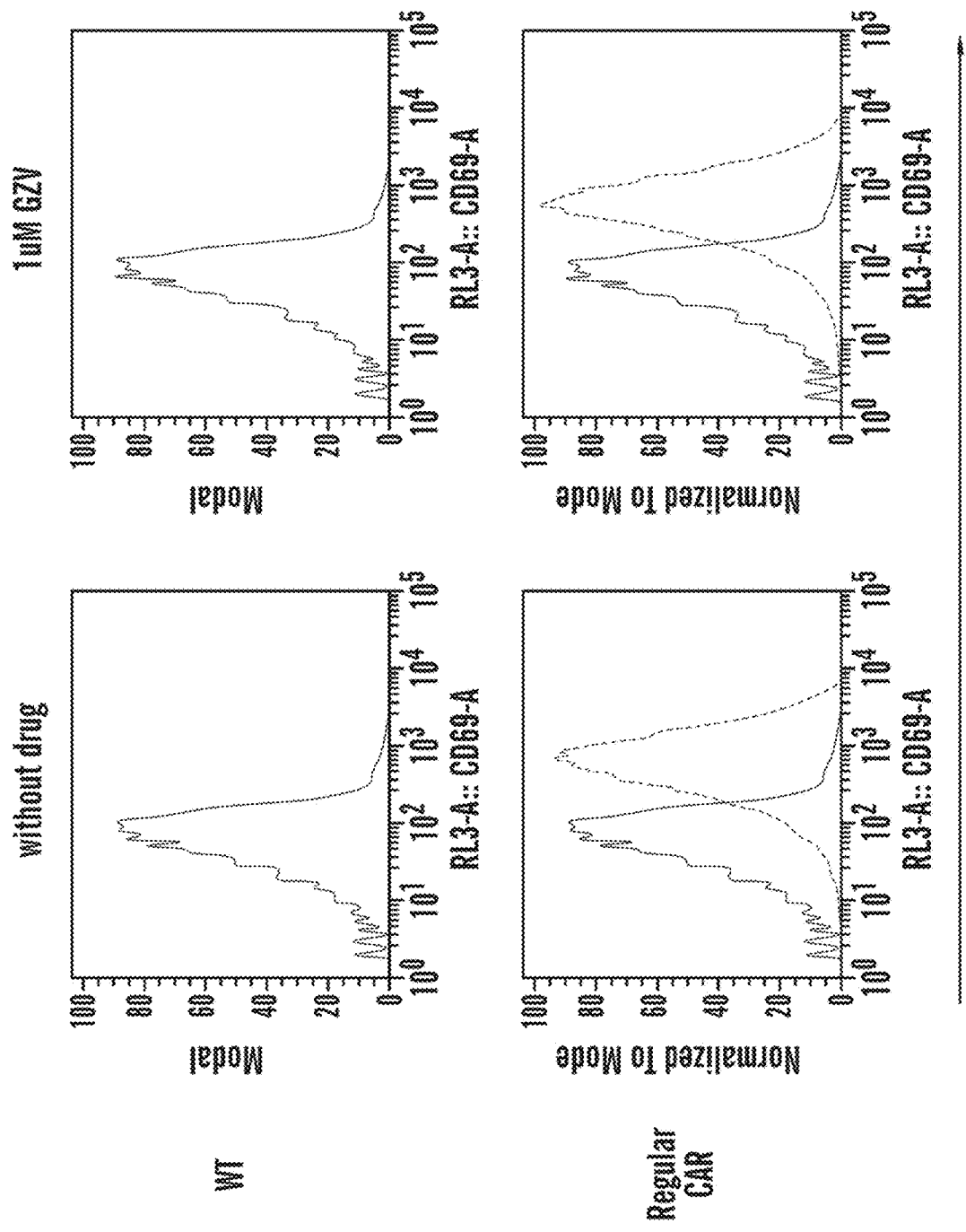
Figure 4C:
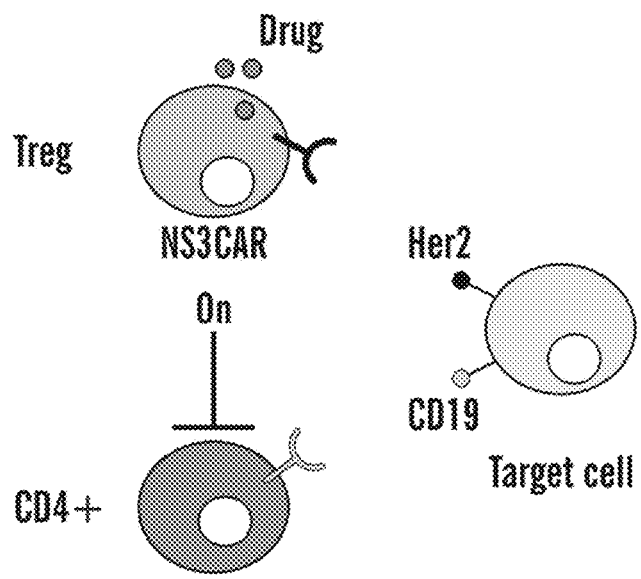
Figure 4C:
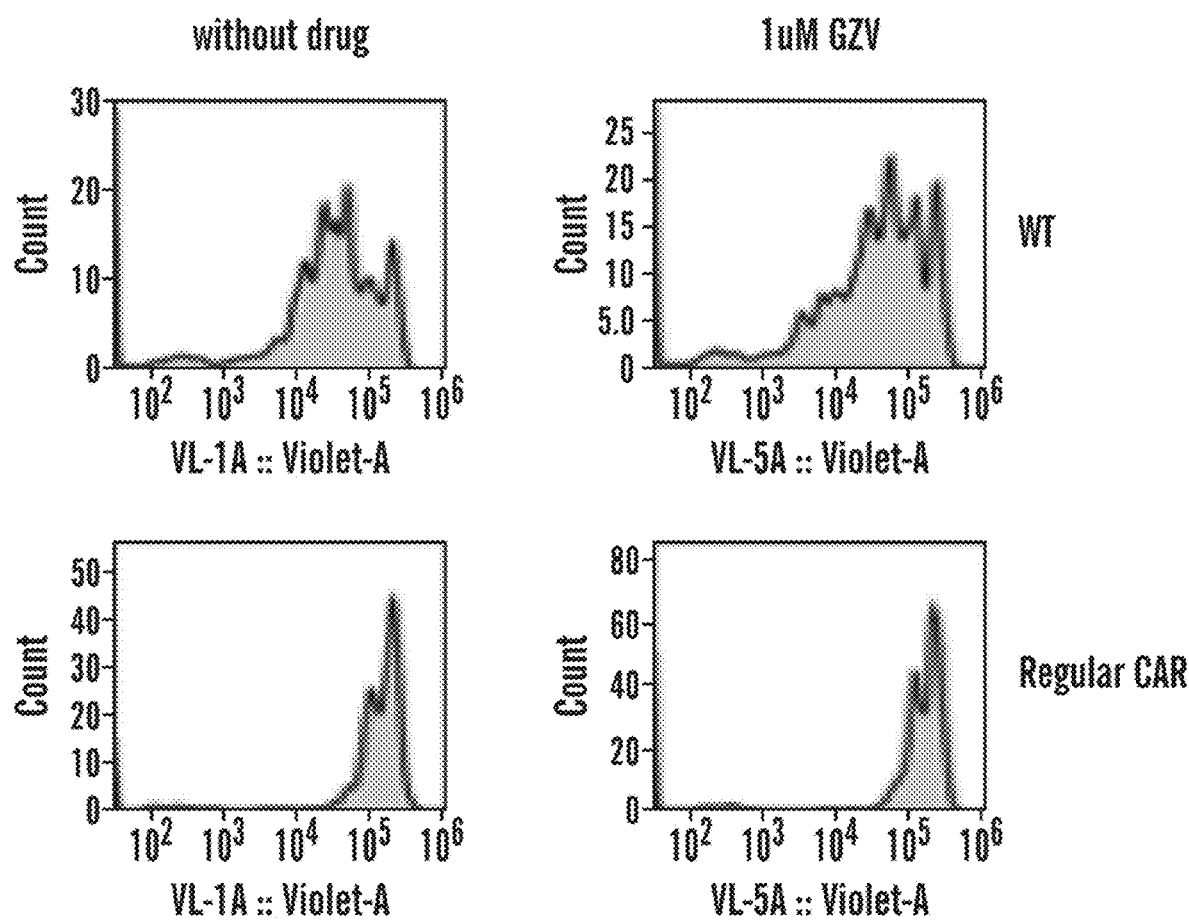
Figure 5A:
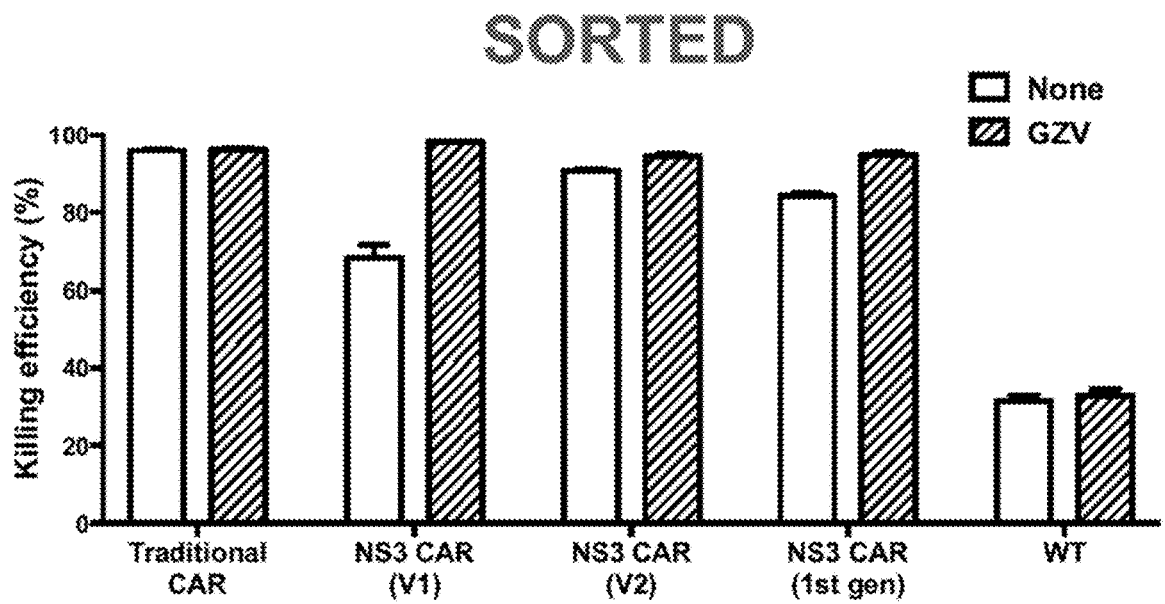
FIG. 5A-5C is a series of graphs showing NS3 CAR expression in natural killer (NK) cells.
Figure 5B:
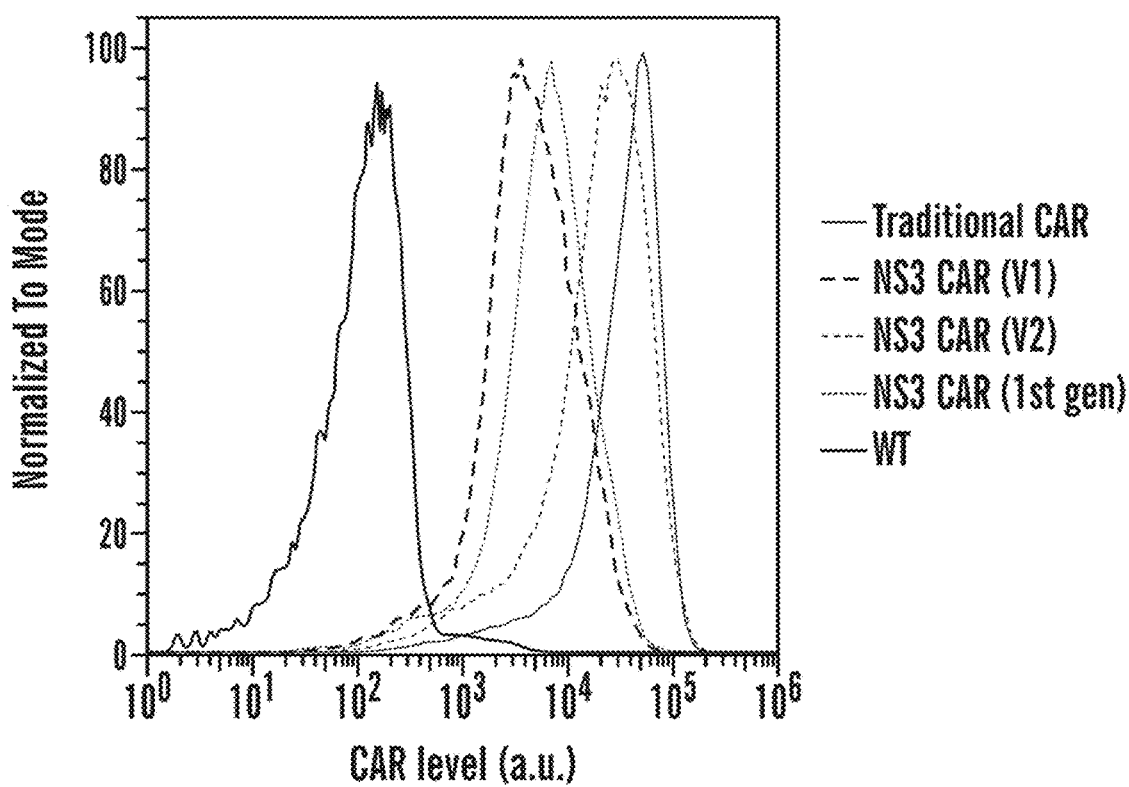
Figure 5C:
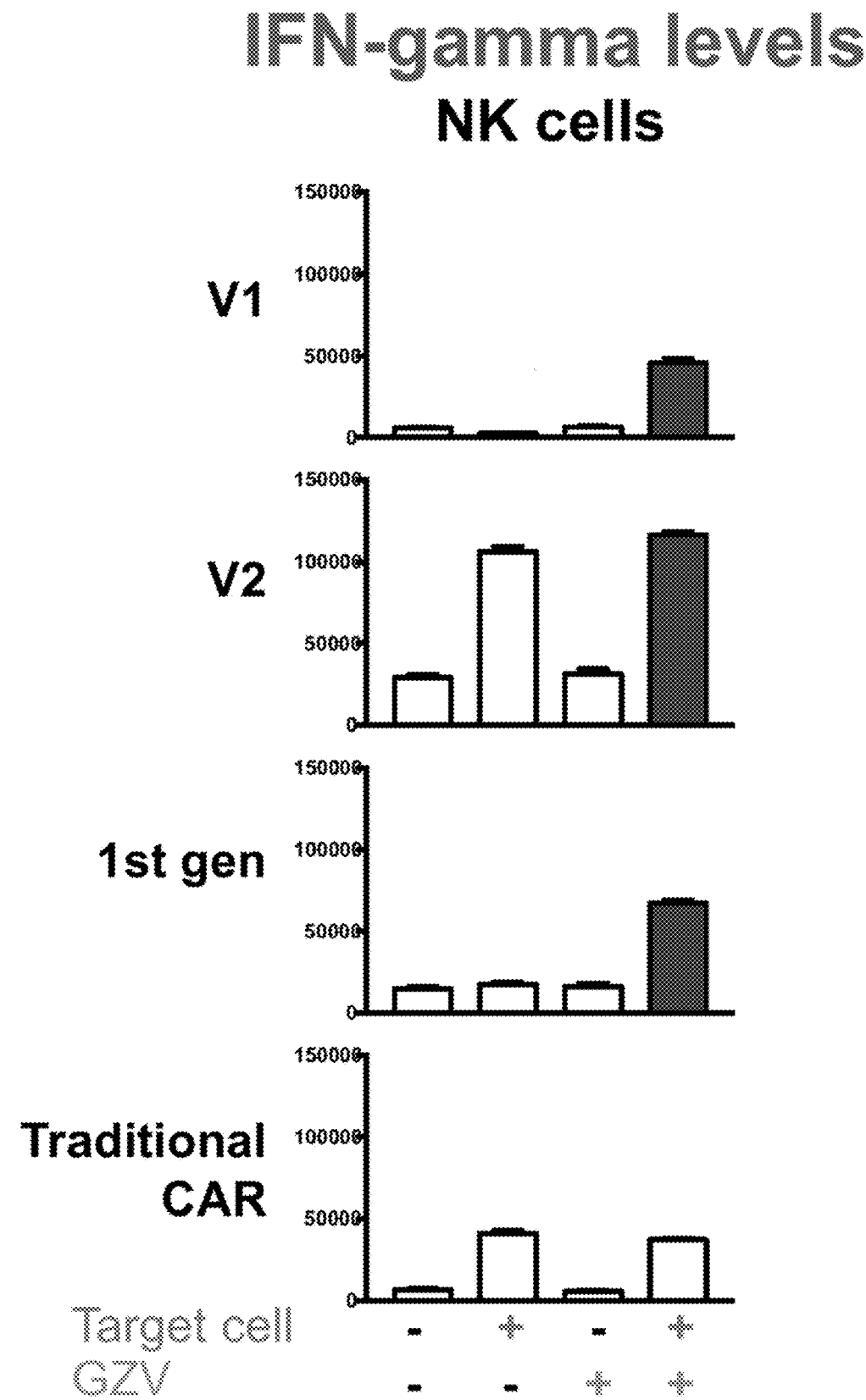

In some embodiments of any of the aspects, specific cells exhibit enhanced expression and/or activity of specific CAR polypeptides. In some embodiments of any of the aspects, the cell is a CD4+ T cell comprising a V2 ON-switch CAR polypeptide (see e.g., FIG. 2A-2B, FIG. 3A-3B; e.g., SEQ ID NOs: 2, 35). In some embodiments of any of the aspects, the cell is a CD8+ T cell comprising a V2 ON-switch CAR polypeptide (see e.g., FIG. 2A-2B, FIG. 3A-3B; e.g., SEQ ID NO: 2, 35). In some embodiments of any of the aspects, the cell is a Treg comprising a V1 or V2 ON-switch CAR polypeptide (see e.g., FIG. 4A-4C; e.g., SEQ ID NOs: 1-2, 34-35). In some embodiments of any of the aspects, the cell is an NK cell comprising a V1 ON-switch CAR polypeptide or a first generation anti-Her2 NS3 CAR (see e.g., FIG. 5A-5C; e.g., SEQ ID NOs: 1, 34, 5, 38).

In some embodiments of any of the aspects, the cell comprises an inactivating modification of at least one HLA Class I gene in the cell. In some embodiments, an endogenous HLA (e.g., class I and/or class II major histocompatibility complexes) can be edited or removed, e.g., to reduce immunogenicity. In some embodiments, the genetic modification can comprise introduction and expression of non-canonical HLA-G and HLA-E to prevent NK cell-mediated lysis (see e.g., Riolobos L et al. 2013), which can provide a source of universal T cells for immunotherapy, e.g., cancer immune therapy. In some embodiments, the native T cell receptor locus can be removed and/or replaced (e.g., with a CAR polypeptide as described herein) to enhance targeted specificity.

Methods of engineering chimeric antigen receptor T cells (also known as CAR T cells) are known in the art. See e.g., US Patents U.S. Pat. Nos. 7,446,190, 8,399,645, 8,822,647, 9,212,229, 9,273,283, 9,447,194, 9,587,020, 9,932,405, U.S. Ser. No. 10/125,193, U.S. Ser. No. 10/221,245, U.S. Ser. No. 10/273,300, U.S. Ser. No. 10/287,354; US patent publication US20160152723; PCT publication WO2009091826, WO2012079000, WO2014165707, WO2015164740, WO2016168595A1, WO2017040945, WO2017100428, WO2017117112, WO2017149515, WO2018067992, WO2018102787, WO2018102786, WO2018165228, WO2019084288; the contents of each of which are incorporated herein by reference in their entireties.

In some embodiments, methods of genetically modifying a cell to express a CAR can comprise but are not limited to: transfection or electroporation of a cell with a vector encoding a CAR; transduction with a viral vector (e.g., retrovirus, lentivirus) encoding a CAR; gene editing using zin finger nucleases (ZFNs), transcription activator-like effector nucleases (TALENs), meganuclease-TALENs, or CRISPR-Cas; or any other methods known in the art of genetically modifying a cell to express a CAR.

In some embodiments of any of the aspects, the cells comprise additional approaches to controlling CAR activity, including suicide genes, dual-antigen receptors, and bi-molecule switches. In some embodiments of any of the aspects, the genetically modified T cells are engineered to include one or more genes that can induce apoptosis when activated by an extracellular molecule. Herpes simplex virus thymidine kinase (HSV-TK) and inducible caspase 9 (iCasp9) are two types of suicide genes that have been integrated into CAR-T cells. In the iCasp9 system, the suicide gene complex has two elements: a mutated FK506-binding protein with high specificity to the small molecule rimiducid/AP1903, and a gene encoding a pro-domain-deleted human caspase 9. Dosing the patient with rimiducid activates the suicide system, leading to rapid apoptosis of the genetically modified T cells. Although both the HSV-TK and iCasp9 systems demonstrate a noticeable function as a safety switch in clinical trials, some defects limit their application. HSV-TK is virus-derived and may be immunogenic to humans. It is also unclear whether the suicide gene strategies will act quickly enough in all situations to halt dangerous off-tumor cytotoxicity.

In the dual-antigen receptor approach, CAR-T cells are engineered to express two tumor-associated antigen receptors at the same time, reducing the likelihood that the T cells will attack non-tumor cells. Dual-antigen receptor CAR-T cells have been reported to have less intense side effects.

In a bispecific molecule switch approach, bispecific molecules target both a tumor-associated antigen and the CD3 molecule on the surface of T cells (e.g., bispecific T cell engagers (BiTEs)). This ensures that the CAR-T cells cannot become activated unless they are in close physical proximity to a tumor cell.

Small molecule drug conjugates adaptor technology can also be used to develop universal CARs. SMDCs (small molecule drug conjugates) platform in immuno-oncology is an experimental approach that makes possible the engineering of a single universal CAR T cell, which binds with extraordinarily high affinity to a benign molecule designated as fluorescein isothiocyanate (FITC). These cells are then used to treat various cancer types when co-administered with bispecific SMDC adaptor molecules. These unique bispecific adaptors are constructed with a FITC molecule and a tumor-homing molecule to precisely bridge the universal CAR T cell with the cancer cells, which causes localized T cell activation. Anti-tumor activity in mice is induced only when both the universal CAR T cells plus the correct antigen-specific adaptor molecules are present. Anti-tumor activity and toxicity can be controlled by adjusting the administered adaptor molecule dosing. Treatment of antigenically heterogeneous tumors can be achieved by administration of a mixture of the desired antigen-specific adaptors.

In some embodiments, the methods described herein relate to treating a subject having or diagnosed as having a disease or disorder (e.g., cancer, alloimmunity, autoimmunity, infectious disease, etc.) with a CAR polypeptide or CAR system as described herein. Subjects having such a disease or disorder can be identified by a physician using current methods of diagnosis for cancer, alloimmunity, autoimmunity, or infectious disease. Symptoms and/or complications which characterize these conditions and aid in diagnosis are known in the art. A family history of cancer, alloimmunity, autoimmunity, or infectious disease, or exposure to risk factors for cancer, alloimmunity, autoimmunity, or infectious disease can also aid in determining if a subject is likely to have such a disease or disorder, or in making a diagnosis of cancer, alloimmunity, autoimmunity, or infectious disease.

The compositions and methods described herein can be administered to a subject having or diagnosed as having cancer, alloimmunity, autoimmunity, or infectious disease. In some embodiments, the methods described herein comprise administering an effective amount of compositions described herein, e.g. a CAR polypeptide as described herein to a subject in order to alleviate a symptom of cancer, alloimmunity, autoimmunity, or infectious disease. As used herein, "alleviating a symptom" is ameliorating any condition or symptom associated with the cancer, alloimmunity, autoimmunity, or infectious disease. As compared with an equivalent untreated control, such reduction is by at least 5%, 10%, 20%, 40%, 50%, 60%, 80%, 90%, 95%, 99% or more as measured by any standard technique.

A variety of means for administering the compositions described herein to subjects are known to those of skill in the art. An agent can be administered intravenously by injection or by gradual infusion over time. Given an appropriate formulation for a given route, for example, agents useful in the methods and compositions described herein can be administered intravenously, intranasally, by inhalation, intraperitoneally, intramuscularly, subcutaneously, intracavity, intratumorally, and can be delivered by peristaltic means, if desired, or by other means known by those skilled in the art. In some embodiments of any of the aspects, the compounds used herein are administered orally, intravenously or intramuscularly. Administration can be local or systemic. Local administration, e.g., directly to the site of an organ or tissue transplant is specifically contemplated.

Therapeutic compositions containing at least one agent can be conventionally administered in a unit dose, for example. The term "unit dose" when used in reference to a therapeutic composition refers to physically discrete units suitable as unitary dosage for the subject, each unit containing a predetermined quantity of active material calculated to produce the desired therapeutic effect in association with the required physiologically acceptable diluent, i.e., carrier, or vehicle.

The compositions are administered in a manner compatible with the dosage formulation, and in a therapeutically effective amount. The quantity to be administered and timing depends on the subject to be treated, capacity of the subject's system to utilize the active ingredient, and degree of therapeutic effect desired.

In embodiments where the subject is administered a CAR cell and a drug to modulate the activity of the CAR polypeptide(s) (e.g., protease inhibitor and/or degron stabilizer), the cells and drug(s) can be administered together or separately. In embodiments where the subject is separately administered a CAR cell and a drug to modulate the activity of the CAR polypeptide(s), each of the compositions can be administered, separately, according to any of the dosages and administration routes/routines described herein.

The term "effective amount" as used herein refers to the amount of a CAR polypeptide as described herein needed to alleviate at least one or more symptom of the disease or disorder, and relates to a sufficient amount of pharmacological composition to provide the desired effect. The term "therapeutically effective amount" therefore refers to an amount of a CAR polypeptide as described herein that is sufficient to provide a particular anti-tumor effect when administered to a typical subject. An effective amount as used herein, in various contexts, would also include an amount sufficient to delay the development of a symptom of the disease, alter the course of a symptom disease (for example but not limited to, slowing the progression of a symptom of the disease), or reverse a symptom of the disease. Thus, it is not generally practicable to specify an exact "effective amount". However, for any given case, an appropriate "effective amount" can be determined by one of ordinary skill in the art using only routine experimentation.

Effective amounts, toxicity, and therapeutic efficacy can be determined by standard pharmaceutical procedures in cell cultures or experimental animals, e.g., for determining the LD50 (the dose lethal to 50% of the population) and the ED50 (the dose therapeutically effective in 50% of the population). The dosage can vary depending upon the dosage form employed and the route of administration utilized. The dose ratio between toxic and therapeutic effects is the therapeutic index and can be expressed as the ratio LD50/ED50. Compositions and methods that exhibit large therapeutic indices are preferred. A therapeutically effective dose can be estimated initially from cell culture assays. Also, a dose can be formulated in animal models to achieve a circulating plasma concentration range that includes the IC50 (i.e., the concentration of a CAR polypeptide as described herein, which achieves a half-maximal inhibition of symptoms) as determined in cell culture, or in an appropriate animal model. Levels in plasma can be measured, for example, by high performance liquid chromatography. The effects of any particular dosage can be monitored by a suitable bioassay. The dosage can be determined by a physician and adjusted, as necessary, to suit observed effects of the treatment.

Effective amounts, toxicity, and therapeutic efficacy can be determined by standard pharmaceutical procedures in cell cultures or experimental animals, e.g., for determining the minimal effective dose and/or maximal tolerated dose. The dosage can vary depending upon the dosage form employed and the route of administration utilized. A therapeutically effective dose can be estimated initially from cell culture assays. Also, a dose can be formulated in animal models to achieve a dosage range between the minimal effective dose and the maximal tolerated dose. The effects of any particular dosage can be monitored by a suitable bioassay, e.g., assay for tumor growth and/or size among others. The dosage can be determined by a physician and adjusted, as necessary, to suit observed effects of the treatment.

It can generally be stated that a pharmaceutical composition comprising the cells, e.g., T cells or CAR cells, described herein may be administered at a dosage of $10^2$ to $10^{10}$ cells/kg body weight, preferably $10^5$ to $10^6$ cells/kg body weight, including all integer values within those ranges. The number of cells will depend upon the ultimate use for which the composition is intended as will the type of cells included therein. For uses provided herein, the cells are generally in a volume of a liter or less, can be 500 mLs or less, even 250 mLs or 100 mLs or less. Hence the density of the desired cells is typically greater than $10^6$ cells/ml and generally is greater than $10^7$ cells/ml, generally $10^8$ cells/ml or greater. The clinically relevant number of immune cells can be apportioned into multiple infusions that cumulatively equal or exceed $10^5$, $10^6$, $10^7$, $10^8$, $10^9$, $10^{10}$, $10^{11}$, or $10^{12}$ cells. In some aspects of the present invention, particularly since all the infused cells will be redirected to a particular target antigen, lower numbers of cells, in the range of $10^6$/kilogram ($10^6$-$10^{11}$ per patient) may be administered. CAR expressing cell compositions may be administered multiple times at dosages within these ranges. The cells may be allogeneic, syngeneic, xenogeneic, or autologous to the patient undergoing therapy. If desired, the treatment may also include administration of mitogens (e.g., PHA) or lymphokines, cytokines, and/or chemokines (e.g., IFN-γ, IL-2, IL-12, TNF-alpha, IL-18, and TNF-beta, GM-CSF, IL-4, IL-13, Flt3-L, RANTES, MIP1α, etc.) as described herein to enhance induction of the immune response. In some embodiments, the dosage can be from about $1\times10^5$ cells to about $1\times10^8$ cells per kg of body weight. In some embodiments, the dosage can be from about $1\times10^6$ cells to about $1\times10^7$ cells per kg of body weight. In some embodiments, the dosage can be about $1\times10^6$ cells per kg of body weight. In some embodiments, one dose of cells can be administered. In some embodiments, the dose of cells can be repeated, e.g., once, twice, or more. In some embodiments, the dose of cells can be administered on, e.g., a daily, weekly, or monthly basis.

In certain embodiments, an effective dose of a composition comprising a CAR composition as described herein can be administered to a patient once. In certain embodiments, an effective dose of a composition comprising a CAR composition can be administered to a patient repeatedly. For systemic administration, subjects can be administered a therapeutic amount of a composition comprising a CAR composition, such as, e.g. 0.1 mg/kg, 0.5 mg/kg, 1.0 mg/kg, 2.0 mg/kg, 2.5 mg/kg, 5 mg/kg, 10 mg/kg, 15 mg/kg, 20 mg/kg, 25 mg/kg, 30 mg/kg, 40 mg/kg, 50 mg/kg, or more.

In some embodiments, the dose can be from about 2 mg/kg to about 15 mg/kg. In some embodiments, the dose can be about 2 mg/kg. In some embodiments, the dose can be about 4 mg/kg. In some embodiments, the dose can be about 5 mg/kg. In some embodiments, the dose can be about 6 mg/kg. In some embodiments, the dose can be about 8 mg/kg. In some embodiments, the dose can be about 10 mg/kg. In some embodiments, the dose can be about 15 mg/kg. In some embodiments, the dose can be from about 100 mg/m² to about 700 mg/m². In some embodiments, the dose can be about 250 mg/m². In some embodiments, the dose can be about 375 mg/m². In some embodiments, the dose can be about 400 mg/m². In some embodiments, the dose can be about 500 mg/m².

In some embodiments, the dose can be administered intravenously. In some embodiments, the intravenous administration can be an infusion occurring over a period of from about 10 minute to about 3 hours. In some embodiments, the intravenous administration can be an infusion occurring over a period of from about 30 minutes to about 90 minutes.

In some embodiments the dose can be administered about weekly. In some embodiments, the dose can be administered weekly. In some embodiments, the dose can be administered weekly for from about 12 weeks to about 18 weeks. In some embodiments the dose can be administered about every 2 weeks. In some embodiments the dose can be administered about every 3 weeks. In some embodiments, the dose can be from about 2 mg/kg to about 15 mg/kg administered about every 2 weeks. In some embodiments, the dose can be from about 2 mg/kg to about 15 mg/kg administered about every 3 weeks. In some embodiments, the dose can be from about 2 mg/kg to about 15 mg/kg administered intravenously about every 2 weeks. In some embodiments, the dose can be from about 2 mg/kg to about 15 mg/kg administered intravenously about every 3 weeks. In some embodiments, the dose can be from about 200 mg/m2 to about 400 mg/m2 administered intravenously about every week. In some embodiments, the dose can be from about 200 mg/m2 to about 400 mg/m2 administered intravenously about every 2 weeks. In some embodiments, the dose can be from about 200 mg/m2 to about 400 mg/m2 administered intravenously about every 3 weeks. In some embodiments, a total of from about 2 to about 10 doses are administered. In some embodiments, a total of 4 doses are administered. In some embodiments, a total of 5 doses are administered. In some embodiments, a total of 6 doses are administered. In some embodiments, a total of 7 doses are administered. In some embodiments, a total of 8 doses are administered. In some embodiments, the administration occurs for a total of from about 4 weeks to about 12 weeks. In some embodiments, the administration occurs for a total of about 6 weeks. In some embodiments, the administration occurs for a total of about 8 weeks. In some embodiments, the administration occurs for a total of about 12 weeks. In some embodiments, the initial dose can be from about 1.5 to about 2.5 fold greater than subsequent doses.

In some embodiments, the dose can be from about 1 mg to about 2000 mg. In some embodiments, the dose can be about 3 mg. In some embodiments, the dose can be about 10 mg. In some embodiments, the dose can be about 30 mg. In some embodiments, the dose can be about 1000 mg. In some embodiments, the dose can be about 2000 mg. In some embodiments, the dose can be about 3 mg given by intravenous infusion daily. In some embodiments, the dose can be about 10 mg given by intravenous infusion daily. In some embodiments, the dose can be about 30 mg given by intravenous infusion three times per week.

In some embodiments, after an initial treatment regimen, the treatments can be administered on a less frequent basis. For example, after treatment biweekly for three months, treatment can be repeated once per month, for six months or a year or longer. Treatment according to the methods described herein can reduce levels of a marker or symptom of a condition, e.g. by at least 10%, at least 15%, at least 20%, at least 25%, at least 30%, at least 40%, at least 50%, at least 60%, at least 70%, at least 80% or at least 90% or more.

The dosage of a composition as described herein can be determined by a physician and adjusted, as necessary, to suit observed effects of the treatment. With respect to duration and frequency of treatment, it is typical for skilled clinicians to monitor subjects in order to determine when the treatment is providing therapeutic benefit, and to determine whether to increase or decrease dosage, increase or decrease administration frequency, discontinue treatment, resume treatment, or make other alterations to the treatment regimen. The dosing schedule can vary from once a week to daily depending on a number of clinical factors, such as the subject's sensitivity to the CAR composition. The desired dose or amount can be administered at one time or divided into subdoses, e.g., 2-4 subdoses and administered over a period of time, e.g., at appropriate intervals through the day or other appropriate schedule. In some embodiments, administration can be chronic, e.g., one or more doses and/or treatments daily over a period of weeks or months. Examples of dosing and/or treatment schedules are administration daily, twice daily, three times daily or four or more times daily over a period of 1 week, 2 weeks, 3 weeks, 4 weeks, 1 month, 2 months, 3 months, 4 months, 5 months, or 6 months, or more. A composition comprising a CAR composition as described herein can be administered over a period of time, such as over a 5 minute, 10 minute, 15 minute, 20 minute, or 25 minute period.

The dosage ranges for the administration of a CAR composition, according to the methods described herein depend upon, for example, the form of the CAR composition, its potency, and the extent to which symptoms, markers, or indicators of a condition described herein are desired to be reduced, for example the percentage reduction desired for the disease or disorder (e.g., cancer). The dosage should not be so large as to cause adverse side effects, such as autoimmunity. Generally, the dosage will vary with the age, condition, and sex of the patient and can be determined by one of skill in the art. The dosage can also be adjusted by the individual physician in the event of any complication.

The efficacy of a CAR composition in, e.g. the treatment of a condition described herein can be determined by the skilled clinician. However, a treatment is considered "effective treatment," as the term is used herein, if one or more of the signs or symptoms of a condition described herein are altered in a beneficial manner, other clinically accepted symptoms are improved, or even ameliorated, or a desired response is induced e.g., by at least 10% following treatment according to the methods described herein. Efficacy can be assessed, for example, by measuring a marker, indicator, symptom, and/or the incidence of a condition treated according to the methods described herein or any other measurable parameter appropriate, e.g. tumor size. Efficacy can also be measured by a failure of an individual to worsen as assessed by hospitalization, or need for medical interventions (i.e., progression of the disease is halted). Methods of measuring these indicators are known to those of skill in the art and/or are described herein. Treatment includes any treatment of a disease in an individual or an animal (some non-limiting examples include a human or an animal) and includes: (1) inhibiting the disease, e.g., preventing a worsening of symptoms (e.g. pain or inflammation); or (2) relieving the severity of the disease, e.g., causing regression of symptoms. An effective amount for the treatment of a disease means that amount which, when administered to a subject in need thereof, is sufficient to result in effective treatment as that term is defined herein, for that disease. Efficacy of an agent can be determined by assessing physical indicators of a condition or desired response, (e.g. tumor size). It is well within the ability of one skilled in the art to monitor efficacy of administration and/or treatment by measuring any one of such parameters, or any combination of parameters. Efficacy can be assessed in animal models of a condition described herein, for example treatment of cancer. When using an experimental animal model, efficacy of treatment is evidenced when a statistically significant change in a marker is observed, e.g. tumor size.

In vitro and animal model assays are provided herein which allow the assessment of a given dose of a CAR composition. The efficacy of a given dosage combination can also be assessed in an animal model, e.g. a specific cancer animal model.

In one aspect, described herein is a pharmaceutical composition comprising the at least one CAR polypeptide, CAR system, CAR polynucleotide, CAR vector, or CAR-comprising cell as described herein, which are collectively referred to as a "CAR composition" (see e.g., Tables 1-5, 7-9, 20). In some embodiments of any of the aspects, the pharmaceutical composition can comprise any combination of CAR polypeptides or systems (see e.g., Table 12). In some embodiments of any of the aspects, the pharmaceutical composition can further comprise a protease inhibitor and/or degron stabilizer as described herein.

In some embodiments, the technology described herein relates to a pharmaceutical composition comprising a CAR composition as described herein, and optionally a pharmaceutically acceptable carrier. In some embodiments, the active ingredients of the pharmaceutical composition comprise the CAR polypeptide, the CAR system, the protease inhibitor, and/or degron stabilizer as described herein. In some embodiments, the active ingredients of the pharmaceutical composition consist essentially of the CAR polypeptide, the CAR system, the protease inhibitor, and/or degron stabilizer as described herein. In some embodiments, the active ingredients of the pharmaceutical composition consist of the CAR polypeptide, the CAR system, the protease inhibitor, and/or degron stabilizer as described herein. Pharmaceutically acceptable carriers and diluents include saline, aqueous buffer solutions, solvents and/or dispersion media. The use of such carriers and diluents is well known in the art. Some non-limiting examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids; (23) serum component, such as serum albumin, HDL and LDL; (24) $C_2$-$C_{12}$ alcohols, such as ethanol; and (25) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein. In some embodiments, the carrier inhibits the degradation of the active agent, e.g. the CAR polypeptide, the CAR system, the protease inhibitor, and/or degron stabilizer as described herein.

In some embodiments, the pharmaceutical composition comprising a CAR composition as described herein can be a parenteral dose form. Since administration of parenteral dosage forms typically bypasses the patient's natural defenses against contaminants, parenteral dosage forms are preferably sterile or capable of being sterilized prior to administration to a patient. Examples of parenteral dosage forms include, but are not limited to, solutions ready for injection, dry products ready to be dissolved or suspended in a pharmaceutically acceptable vehicle for injection, suspensions ready for injection, and emulsions. In addition, controlled-release parenteral dosage forms can be prepared for administration of a patient, including, but not limited to, DUROS®-type dosage forms and dose-dumping.

Suitable vehicles that can be used to provide parenteral dosage forms of CAR compositions as disclosed within are well known to those skilled in the art. Examples include, without limitation: sterile water; water for injection USP; saline solution; glucose solution; aqueous vehicles such as but not limited to, sodium chloride injection, Ringer's injection, dextrose Injection, dextrose and sodium chloride injection, and lactated Ringer's injection; water-miscible vehicles such as, but not limited to, ethyl alcohol, polyethylene glycol, and propylene glycol; and non-aqueous vehicles such as, but not limited to, corn oil, cottonseed oil, peanut oil, sesame oil, ethyl oleate, isopropyl myristate, and benzyl benzoate.

Pharmaceutical compositions comprising CAR compositions can also be formulated to be suitable for oral administration, for example as discrete dosage forms, such as, but not limited to, tablets (including without limitation scored or coated tablets), pills, caplets, capsules, chewable tablets, powder packets, cachets, troches, wafers, aerosol sprays, or liquids, such as but not limited to, syrups, elixirs, solutions or suspensions in an aqueous liquid, a non-aqueous liquid, an oil-in-water emulsion, or a water-in-oil emulsion. Such compositions contain a predetermined amount of the pharmaceutically acceptable salt of the disclosed compounds, and may be prepared by methods of pharmacy well known to those skilled in the art. See generally, Remington: The Science and Practice of Pharmacy, 21st Ed., Lippincott, Williams, and Wilkins, Philadelphia Pa. (2005).

Conventional dosage forms generally provide rapid or immediate drug release from the formulation. Depending on the pharmacology and pharmacokinetics of the drug, use of conventional dosage forms can lead to wide fluctuations in the concentrations of the drug in a patient's blood and other tissues. These fluctuations can impact a number of parameters, such as dose frequency, onset of action, duration of efficacy, maintenance of therapeutic blood levels, toxicity, side effects, and the like. Advantageously, controlled-release formulations can be used to control a drug's onset of action, duration of action, plasma levels within the therapeutic window, and peak blood levels. In particular, controlled- or extended-release dosage forms or formulations can be used to ensure that the maximum effectiveness of a drug is achieved while minimizing potential adverse effects and safety concerns, which can occur both from under-dosing a drug (i.e., going below the minimum therapeutic levels) as well as exceeding the toxicity level for the drug. In some embodiments, the composition can be administered in a sustained release formulation.

Controlled-release pharmaceutical products have a common goal of improving drug therapy over that achieved by their non-controlled release counterparts. Ideally, the use of an optimally designed controlled-release preparation in medical treatment is characterized by a minimum of drug substance being employed to cure or control the condition in a minimum amount of time. Advantages of controlled-release formulations include: 1) extended activity of the drug; 2) reduced dosage frequency; 3) increased patient compliance; 4) usage of less total drug; 5) reduction in local or systemic side effects; 6) minimization of drug accumulation; 7) reduction in blood level fluctuations; 8) improvement in efficacy of treatment; 9) reduction of potentiation or loss of drug activity; and 10) improvement in speed of control of diseases or conditions. Kim, Cherng-ju, Controlled Release Dosage Form Design, 2 (Technomic Publishing, Lancaster, Pa.: 2000).

Most controlled-release formulations are designed to initially release an amount of drug (active ingredient) that promptly produces the desired therapeutic effect, and gradually and continually release other amounts of drug to maintain this level of therapeutic or prophylactic effect over an extended period of time. In order to maintain this constant level of drug in the body, the drug must be released from the dosage form at a rate that will replace the amount of drug being metabolized and excreted from the body. Controlled-release of an active ingredient can be stimulated by various conditions including, but not limited to, pH, ionic strength, osmotic pressure, temperature, enzymes, water, and other physiological conditions or compounds.

A variety of known controlled- or extended-release dosage forms, formulations, and devices can be adapted for use with the salts and compositions of the disclosure. Examples include, but are not limited to, those described in U.S. Pat. Nos. 3,845,770; 3,916,899; 3,536,809; 3,598,123; 4,008,719; 5,674,533; 5,059,595; 5,591,767; 5,120,548; 5,073,543; 5,639,476; 5,354,556; 5,733,566; and 6,365,185 B1; each of which is incorporated herein by reference. These dosage forms can be used to provide slow or controlled-release of one or more active ingredients using, for example, hydroxypropylmethyl cellulose, other polymer matrices, gels, permeable membranes, osmotic systems (such as OROS® (Alza Corporation, Mountain View, Calif. USA)), or a combination thereof to provide the desired release profile in varying proportions.

In some embodiments of any of the aspects, the CAR composition described herein is administered as a monotherapy, e.g., another treatment for the disease or disorder (e.g., cancer) is not administered to the subject.

In some embodiments of any of the aspects, the methods described herein can further comprise administering a second agent and/or treatment to the subject, e.g. as part of a combinatorial therapy. Non-limiting examples of a second agent and/or treatment can include radiation therapy, surgery, gemcitabine, cisplatin, paclitaxel, carboplatin, bortezomib, AMG479, vorinostat, rituximab, temozolomide, rapamycin, ABT-737, PI-103; alkylating agents such as thiotepa and CYTOXAN® cyclophosphamide; alkyl sulfonates such as busulfan, improsulfan and piposulfan; aziridines such as benzodopa, carboquone, meturedopa, and uredopa; ethylenimines and methylmelamines including altretamine, triethylenemelamine, trietylenephosphoramide, triethylenethiophosphoramide and trimethylol melamine; acetogenins (especially bullatacin and bullatacinone); a camptothecin (including the synthetic analogue topotecan);

bryostatin; callystatin; CC-1065 (including its adozelesin, carzelesin and bizelesin synthetic analogues); cryptophycins (particularly cryptophycin 1 and cryptophycin 8); dolastatin; duocarmycin (including the synthetic analogues, KW-2189 and CB 1-TM1); eleutherobin; pancratistatin; a sarcodictyin; spongistatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosoureas such as carmustine, chlorozotocin, fotemustine, lomustine, nimustine, and ranimustine; antibiotics such as the enediyne antibiotics (e.g., calicheamicin, especially calicheamicin gammall and calicheamicin omegall (see, e.g., Agnew, Chem. Intl. Ed. Engl., 33: 183-186 (1994)); dynemicin, including dynemicin A; bisphosphonates, such as clodronate; an esperamicin; as well as neocarzinostatin chromophore and related chromoprotein enediyne antibiotic chromophores), aclacinomycins, actinomycin, authramycin, azaserine, bleomycins, cactinomycin, carabicin, caminomycin, carzinophilin, chromomycins, dactinomycin, daunorubicin, detorubicin, 6-diazo-5-oxo-L-norleucine, ADRIAMYCIN® doxorubicin (including morpholino-doxorubicin, cyanomorpholino-doxorubicin, 2-pyrrolino-doxorubicin and deoxydoxorubicin), epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elformithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; podophyllinic acid; 2-ethylhydrazide; procarbazine; PSK® polysaccharide complex (JHS Natural Products, Eugene, Oreg.); razoxane; rhizoxin; sizofuran; spirogermanium; tenuazonic acid; triaziquone; 2,2',2"-trichlorotriethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; taxoids, e.g., TAXOL® paclitaxel (Bristol-Myers Squibb Oncology, Princeton, N.J.), ABRAXANE® Cremophor-free, albumin-engineered nanoparticle formulation of paclitaxel (American Pharmaceutical Partners, Schaumberg, Ill.), and TAXOTERE® doxetaxel (Rhone-Poulenc Rorer, Antony, France); chloranbucil; GEMZAR® gemcitabine; 6-thioguanine; mercaptopurine; methotrexate; platinum analogs such as cisplatin, oxaliplatin and carboplatin; vinblastine; platinum; etoposide (VP-16); ifosfamide; mitoxantrone; vincristine; NAVELBINE® vinorelbine; novantrone; teniposide; edatrexate; daunomycin; aminopterin; xeloda; ibandronate; irinotecan (Camptosar, CPT-11) (including the treatment regimen of irinotecan with 5-FU and leucovorin); topoisomerase inhibitor RFS 2000; difluoromethylornithine (DMFO); retinoids such as retinoic acid; capecitabine; combretastatin; leucovorin (LV); oxaliplatin, including the oxaliplatin treatment regimen (FOLFOX); lapatinib (Tykerb®); inhibitors of PKC-alpha, Raf, H-Ras, EGFR (e.g., erlotinib (Tarceva®)) and VEGF-A that reduce cell proliferation and pharmaceutically acceptable salts, acids or derivatives of any of the above.

In addition, the methods of treatment can further include the use of radiation or radiation therapy. Further, the methods of treatment can further include the use of surgical treatments.

The CAR compositions described herein can be administered to a subject in need thereof, in particular the treatment of cancer. In some embodiments of any of the aspects, the CAR compositions described herein can be administered for the treatment of cancer, autoimmunity, alloimmunity, or infectious disease. Autoimmunity is the system of immune responses of an organism against its own healthy cells and tissues. Any disease that results from such an aberrant immune response is termed an "autoimmune disease". Alloimmunity (sometimes called isoimmunity) is an immune response to non-self antigens from members of the same species, which are called alloantigens or isoantigens. Two major types of alloantigens are blood group antigens and histocompatibility antigens. Infectious diseases that can be treated with the CAR compositions described herein include any microorganism with a specific microbial antigen that can be targeted; the infectious diseases can be viral (e.g., HIV), bacterial, or fungal infections.

In some embodiments, the method of treatment can comprise first diagnosing a subject or patient who can benefit from treatment by a composition described herein. In some embodiments, such diagnosis comprises detecting or measuring an abnormal level of a marker (e.g., the tumor antigens as described herein) in a sample from the subject or patient. In some embodiments, the method further comprises administering to the patient a CAR composition as described herein.

In some embodiments, the subject has previously been determined to have an abnormal level of an analyte described herein relative to a reference. In some embodiments, the reference level can be the level in a sample of similar cell type, sample type, sample processing, and/or obtained from a subject of similar age, sex and other demographic parameters as the sample/subject. In some embodiments, the test sample and control reference sample are of the same type, that is, obtained from the same biological source, and comprising the same composition, e.g. the same number and type of cells.

The term "sample" or "test sample" as used herein denotes a sample taken or isolated from a biological organism, e.g., a blood or plasma sample from a subject. In some embodiments of any of the aspects, the technology described herein encompasses several examples of a biological sample. In some embodiments of any of the aspects, the biological sample is cells, or tissue, or peripheral blood, or bodily fluid. Exemplary biological samples include, but are not limited to, a biopsy, a tumor sample, biofluid sample; blood; serum; plasma; urine; sperm; mucus; tissue biopsy; organ biopsy; synovial fluid; bile fluid; cerebrospinal fluid; mucosal secretion; effusion; sweat; saliva; and/or tissue sample etc. The term also includes a mixture of the above-mentioned samples. The term "test sample" also includes untreated or pretreated (or pre-processed) biological samples. In some embodiments of any of the aspects, a test sample can comprise cells from a subject.

In some embodiments of any of the aspects, the step of determining if the subject has an abnormal level of an analyte described herein can comprise i) obtaining or having obtained a sample from the subject and ii) performing or having performed an assay on the sample obtained from the subject to determine/measure the level of the analyte in the subject. In some embodiments of any of the aspects, the step of determining if the subject has an abnormal level of an analyte described herein can comprise performing or having performed an assay on a sample obtained from the subject to determine/measure the level of analyte in the subject. In some embodiments of any of the aspects, the step of determining if the subject has an abnormal level of an analyte described herein can comprise ordering or requesting an assay on a sample obtained from the subject to determine/measure the level of the analyte in the subject. In some embodiments of any of the aspects, the step of determining if the subject has an abnormal level of an analyte described herein can comprise receiving the results of an assay on a sample obtained from the subject to determine/measure the level of the analyte in the subject. In some embodiments of any of the aspects, the step of determining if the subject has an abnormal level of an analyte described herein can comprise receiving a report, results, or other means of identifying the subject as a subject with a decreased level of the analyte.

In one aspect of any of the embodiments, described herein is a method of treating cancer (or another disease or disorder as described herein) in a subject in need thereof, the method comprising: a) determining if the subject has an abnormal level of an analyte described herein; and b) instructing or directing that the subject be administered a CAR composition as described herein if the level of the analyte is increased or otherwise abnormal relative to a reference. In some embodiments of any of the aspects, the step of instructing or directing that the subject be administered a particular treatment can comprise providing a report of the assay results. In some embodiments of any of the aspects, the step of instructing or directing that the subject be administered a particular treatment can comprise providing a report of the assay results and/or treatment recommendations in view of the assay results.

In one aspect, described herein is a method of decreasing the degradation of a CAR polypeptide, comprising the steps of: (a) providing a population of cells comprising an ON-switch CAR polypeptide or an AND-gate CAR system as described herein; and (b) contacting the population of cells with an effective amount of a protease inhibitor and/or an effective amount of a degron stabilizer.

In one aspect, described herein is a method of decreasing the degradation of a polypeptide, comprising the steps of: (a) providing a population of cells comprising an ON-switch CAR polypeptide as described herein; and (b) contacting the population of cells with an effective amount of a protease inhibitor.

In one aspect, described herein is a method of decreasing the degradation of a polypeptide, comprising the steps of: (a) providing a population of cells comprising an AND-gate CAR system as described herein; and (b) contacting the population of cells with an effective amount of a protease inhibitor and an effective amount of a degron stabilizer. In some embodiments of any of the aspects, the degron of the AND-gate CAR system is DHFR degron and the degron stabilizer is trimethoprim (TMP) or an analog thereof.

In one aspect, described herein is a method of modulating the degradation of a polypeptide system, comprising the steps of: (a) providing a population of cells comprising an AND-gate polypeptide or system described herein; (b) contacting the population of cells with an effective amount of a protease inhibitor to decrease the degradation of the polypeptide system; and (c) contacting the population of cells with an effective amount of a degron destabilizer to increase the degradation of the polypeptide system. In some embodiments of any of the aspects, the degron is a ligand-induced degradation (LID) domain and the degron destabilizer is Shield-1 or an analog thereof.

In some embodiments of any of the aspects, the degradation of the ON-switch CAR polypeptide or AND-gate CAR polypeptide is decreased by at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the protease inhibitor and/or or degron stabilizer.

In some embodiments of any of the aspects, the decrease in degradation results in an increase of activity of the ON-switch CAR polypeptide or AND-gate CAR system of at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the protease inhibitor and/or degron stabilizer. In some embodiments of any of the aspects, the increase of activity of the polypeptide comprises an increase in intracellular signaling of the intracellular signaling domains of the polypeptide.

In some embodiments of any of the aspects, the increase in intracellular signaling results in an increase of activation of the population of cells. In some embodiments of any of the aspects, the activation of the population of cells comprises expression of activation markers comprising CD69. Non-limiting examples of markers for T cell activation include CD107a, CD69, NFAT, CD25, and HLA-DR. In some embodiments of any of the aspects, the activation of the population of cells comprises cytokines comprising IL-2 and IFNg. Non-limiting examples of T cell cytokines include IL-2, IFNg, TNFa, lymphotoxin, and granulocyte-macrophage colony-stimulating factor (GM-CSF).

In some embodiments of any of the aspects, an increase of activation of the population of cells results in an increased killing efficiency of a target cell. In some embodiments of any of the aspects, the target cell is a tumor cell or a cancer cell. In some embodiments of any of the aspects, the target cell is a tumor or cancer cell expressing the cognate antigen for the extracellular binding domain of the CAR polypeptide or CAR system.

In some embodiments of any of the aspects, the degradation is increased by at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the degron destabilizer. In some embodiments of any of the aspects, the increase in degradation results in a decrease of activity of the polypeptide of at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the degron destabilizer. In some embodiments of any of the aspects, the decrease of activity of the polypeptide system comprises a decrease in intracellular signaling of the intracellular signaling domains of the polypeptide system. In some embodiments of any of the aspects, the decrease in intracellular signaling results in a decrease of activation of the population of cells. In some embodiments of any of the aspects, a decrease of activation of the population of cells results in a decreased killing efficiency of a target cell. In some embodiments of any of the aspects, the target cell expresses an antigen that binds to the extracellular binding domain of the first polypeptide of the system and an antigen that binds to the extracellular binding domain of the second polypeptide of the system.

In some embodiments of any of the aspects, the population of cells comprises immune cells. In some embodiments of any of the aspects, the population of immune cells comprises CD4+ T cells, CD8+ T cells, Tregs, or NK cells.

In one aspect, described herein is a method of treating a subject in need of a cell-based therapy. In some embodiments of any of the aspects, a subject in need of a cell-based therapy comprises a subject with cancer, alloimmunity, autoimmunity, infectious disease or another disease or disorder as described herein. Accordingly, the method comprises the steps of: (a) administering to the subject a population of cells comprising an ON-switch CAR polypeptide or an AND-gate CAR system as described herein; and (b) administering to the subject an effective amount of a protease inhibitor and/or an effective amount of a degron stabilizer. In some embodiments of any of the aspects, the subject has a cancer expressing an antigen that binds to the extracellular binding domain of the polypeptide.

In one aspect, described herein is a method of treating a subject in need of a cell-based therapy comprising the steps of: (a) administering to the subject a population of cells comprising an ON-switch CAR polypeptide as described herein; and (b) administering to the subject an effective amount of a protease inhibitor.

In one aspect, described herein is a method of treating a subject in need of a cell-based therapy comprising the steps of: (a) administering to the subject a population of cells comprising an AND-gate CAR system as described herein; and (b) administering to the subject an effective amount of a protease inhibitor and an effective amount of a degron stabilizer. In some embodiments of any of the aspects, the degron of the AND-gate CAR system is DHFR degron and the degron stabilizer is trimethoprim (TMP) or an analog thereof.

In one aspect described herein is a method of treating a subject in need of a cell-based therapy comprising the steps of: (a) administering to the subject a population of cells comprising an AND-gate CAR polypeptide or system as described herein; (b) administering to the subject an effective amount of a protease inhibitor; and (c) administering to the subject an effective amount of a degron destabilizer. In some embodiments of any of the aspects, the degron of the ANG-gate CAR system is a ligand-induced degradation (LID) domain and the degron destabilizer is Shield-1 or an analog thereof.

In some embodiments of any of the aspects, the protease inhibitor, degron stabilizer, and/or degron destabilizer is administered at the same time the population of cells is administered. In some embodiments of any of the aspects, the protease inhibitor, degron stabilizer, and/or degron destabilizer is administered after the population of cells is administered. As a non-limiting example, the protease inhibitor, degron stabilizer, and/or degron destabilizer is administered at least 1 minute, at least 2 minutes, at least 3 minutes, at least 4 minutes, at least 5 minutes, at least 10 minutes, at least 20 minutes, at least 30 minutes, at least 1 hour, at least 2 hours, at least 3 hours, at least 6 hours, at least 12 hours, at least 24 hours, at least 2 days, at least 3 days, at least 4 days, at least 5 days, at least 6 days, at least 7 days, at least 1.5 weeks, at least 2 weeks, at least 3 weeks, at least 4 weeks, at least 5 weeks, at least 6 weeks, at least 7 weeks, at least 8 weeks, at least 9 weeks, at least 10 weeks, at least 1 month, at least 2 months, at least 3 months, at least 4 months, at least 5 months, at least 6 months, at least 7 months, at least 8 months, at least 9 months, at least 10 months, at least 11 months, or at least 1 year after the population of cells is administered. In some embodiments of any of the aspects, the protease inhibitor, degron stabilizer, and/or degron destabilizer is administered continuously, e.g., using an IV.

In some embodiments of any of the aspects, a withdrawal or decrease in concentration (e.g., below an effective level) of the protease inhibitor and/or degron stabilizer results in increased degradation of the ON-switch or AND-gate CAR polypeptide(s). In some embodiments of any of the aspects, a withdrawal or decrease in concentration of the protease inhibitor and/or degron stabilizer results in decreased activity of the ON-switch or AND-gate CAR polypeptide(s). In some embodiments of any of the aspects, the concentration of the protease inhibitor and/or degron stabilizer is withdrawn or decreased below an effective level due to adverse side effects of the ON-switch or AND-gate CAR system. In some embodiments of any of the aspects, the concentration of the protease inhibitor and/or degron stabilizer is withdrawn or decreased below an effective level due to completion of the ON-switch or AND-gate CAR cell-based therapy and/or successful treatment of the disease or disorder (e.g., cancer).

In some embodiments of any of the aspects, an increase in concentration (e.g., above an effective level) of the degron destabilizer results in increased degradation of the AND-gate CAR polypeptide. In some embodiments of any of the aspects, an increase in concentration of the degron destabilizer results in decreased activity of the AND-gate CAR polypeptide. In some embodiments of any of the aspects, the concentration of the degron destabilizer is increased above an effective level due to adverse side effects of the AND-gate CAR system. In some embodiments of any of the aspects, the concentration of the degron destabilizer is increased above an effective level due to completion of the AND-gate CAR cell-based therapy and/or successful treatment of the disease or disorder (e.g., cancer).

In one aspect, described herein is a method of decreasing the activity of a polypeptide system, comprising the steps of: (a) providing a population of cells comprising an OFF-switch CAR polypeptide or an OFF-switch CAR system as described herein; and (b) contacting the population of cells with an effective amount of a protease inhibitor. In some embodiments of any of the aspects, the population of cells comprises immune cells. In some embodiments of any of the aspects, the population of immune cells comprises CD4+ T cells, CD8+ T cells, Tregs, or NK cells.

In some embodiments of any of the aspects, wherein the activity (e.g., of the OFF-switch CAR polypeptide) is decreased by at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the protease inhibitor.

In some embodiments of any of the aspects, the decrease of activity of the OFF-switch CAR polypeptide system comprises a decrease in intracellular signaling of the intracellular signaling domains of the polypeptide system. In some embodiments of any of the aspects, the decrease in intracellular signaling results in a decrease of activation of the population of cells. In some embodiments of any of the aspects, the activation of the population of cells comprises expression of activation markers (e.g., CD69 or other activation markers as described herein) and/or expression of cytokines (e.g., IL-2, IFNg, or other cytokines as described herein).

In some embodiments of any of the aspects, a decrease of activation of the population of cells (e.g., comprising an OFF-switch CAR system) results in a decreased killing efficiency of a target cell. In some embodiments of any of the aspects, the target cell expresses an antigen that binds to the extracellular binding domain of one or both of the OFF-switch CAR polypeptides.

In one aspect, described herein is a method of treating a subject in need of a cell-based therapy comprising the steps of: (a) administering to the subject a population of cells comprising an OFF-switch polypeptide or system as described herein; and (b) administering to the subject an effective amount of a protease inhibitor. In some embodiments of any of the aspects, the subject has a cancer expressing an antigen that binds to the extracellular binding domain of the polypeptide.

In some embodiments of any of the aspects, the protease inhibitor is administered at the same time the population of cells is administered. In some embodiments of any of the aspects, the protease inhibitor is administered after the population of cells is administered. As a non-limiting example, the protease inhibitor is administered at least 1 minute, at least 2 minutes, at least 3 minutes, at least 4 minutes, at least 5 minutes, at least 10 minutes, at least 20 minutes, at least 30 minutes, at least 1 hour, at least 2 hours, at least 3 hours, at least 6 hours, at least 12 hours, at least 24 hours, at least 2 days, at least 3 days, at least 4 days, at least 5 days, at least 6 days, or at least 7 days after the population of cells is administered. In some embodiments of any of the aspects, the protease inhibitor is administered continuously, e.g., using an IV.

In some embodiments of any of the aspects, an increase in concentration of the protease inhibitor results in decreased activity of the OFF-switch CAR polypeptide system. In some embodiments of any of the aspects, the concentration of the protease inhibitor is increased above an effective level due to adverse side effects of the OFF-switch CAR composition. In some embodiments of any of the aspects, the concentration of the protease inhibitor is increased above an effective level due to completion of the cell-based therapy and/or successful treatment of the disease or disorder (e.g., cancer).

In one aspect, described herein is a method of increasing the activity of a polypeptide system, comprising the steps of: (a) providing a population of cells comprising a reader CAR polypeptide system as described herein; and (b) contacting the population of cells with an effective amount of a protease inhibitor. In some embodiments of any of the aspects, the population of cells comprises immune cells. In some embodiments of any of the aspects, the population of immune cells comprises CD4+ T cells, CD8+ T cells, Tregs, or NK cells.

In some embodiments of any of the aspects, the activity of the reader CAR system is increased by at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the protease inhibitor.

In some embodiments of any of the aspects, the increase of activity of the reader polypeptide system comprises an increase in intracellular signaling of the intracellular signaling domains of the polypeptide system. In some embodiments of any of the aspects, the increase in intracellular signaling results in an increase of activation of the population of cells. In some embodiments of any of the aspects, the activation of the population of cells comprises expression of activation markers (e.g., CD69 or other activation markers as described herein) and/or expression of cytokines (e.g., IL-2, IFNg, or other cytokines as described herein).

In some embodiments of any of the aspects, an increase of activation of the population of cells (e.g. comprising a reader CAR system) results in an increased killing efficiency of a target cell. In some embodiments of any of the aspects, the target cell expresses an antigen that binds to the extracellular binding domain of a reader CAR polypeptide.

In one aspect, described herein is a method of treating a subject in need of a cell-based therapy comprising the steps of: (a) administering to the subject a population of cells comprising a reader CAR polypeptide system as described herein; and (b) administering to the subject an effective amount of a protease inhibitor. In some embodiments of any of the aspects, the subject has a cancer expressing an antigen that binds to the extracellular binding domain of the reader CAR polypeptide(s).

In some embodiments of any of the aspects, the protease inhibitor is specific to the reader CAR polypeptide. As a non-limiting example, danoprevir is administered in combination with a danoprevir-responsive reader (e.g., DNCR2), and grazoprevir is administered in combination with a grazoprevir-responsive reader (e.g., GNCR1). In some embodiments of any of the aspects, the protease inhibitor is administered at the same time the population of cells is administered. In some embodiments of any of the aspects, the protease inhibitor is administered after the population of cells is administered. As a non-limiting example, the protease inhibitor is administered at least 1 minute, at least 2 minutes, at least 3 minutes, at least 4 minutes, at least 5 minutes, at least 10 minutes, at least 20 minutes, at least 30 minutes, at least 1 hour, at least 2 hours, at least 3 hours, at least 6 hours, at least 12 hours, at least 24 hours, at least 2 days, at least 3 days, at least 4 days, at least 5 days, at least 6 days, or at least 7 days after the population of cells is administered. In some embodiments of any of the aspects, the protease inhibitor is administered continuously, e.g., using an IV.

In some embodiments of any of the aspects, an increase in concentration of the protease inhibitor results in increased activity of the reader CAR polypeptide system. In some embodiments of any of the aspects, the concentration of the protease inhibitor is withdrawn or decreased below an effective level due to adverse side effects of the reader CAR composition. In some embodiments of any of the aspects, the concentration of the protease inhibitor is withdrawn or decreased below an effective level due to completion of the reader CAR cell-based therapy and/or successful treatment of the disease or disorder (e.g., cancer).

In some embodiments of any of the aspects, the reader CAR system comprises multiple reader CAR polypeptides that are each responsive to a specific protease inhibitor, e.g., a "three-component reader CAR system" or "multi-component reader CAR system" as described further herein. Accordingly, in one aspect described herein is a method of modulating activity of a reader CAR system comprising: (a) providing a population of cells comprising a three-component (or 4 or 5 or more) reader CAR polypeptide system; (b) contacting the population of cells with an effective amount of a first protease inhibitor that binds to the first reader CAR polypeptide to increase the activity of the first reader CAR polypeptide; (c) contacting the population of cells with an effective amount of a second protease inhibitor that binds to the second reader CAR polypeptide to increase the activity of the second reader CAR polypeptide; and so forth for any additional reader CAR polypeptides with a different reader domain from the first two reader CAR polypeptides.

In another aspect, described herein is a method of treating a subject in need of a cell-based therapy comprising the steps of: (a) administering to the subject a population of cells comprising a three-component (or 4 or 5 or more) reader CAR polypeptide system as described herein; (b) administering to the subject an effective amount of a first protease inhibitor that binds to the first reader CAR polypeptide to target the antigen of the first reader CAR polypeptide; (c) administering to the subject an effective amount of a second protease inhibitor that binds to the second reader CAR polypeptide to target the antigen of the second reader CAR polypeptide; and so forth for any additional reader CAR polypeptides with a different reader domain from the first two reader CAR polypeptides.

As used herein, the term "cancer" relates generally to a class of diseases or conditions in which abnormal cells divide without control and can invade nearby tissues. Cancer cells can also spread to other parts of the body through the blood and lymph systems. There are several main types of cancer. Carcinoma is a cancer that begins in the skin or in tissues that line or cover internal organs. Sarcoma is a cancer that begins in bone, cartilage, fat, muscle, blood vessels, or other connective or supportive tissue. Leukemia is a cancer that starts in blood-forming tissue such as the bone marrow, and causes large numbers of abnormal blood cells to be produced and enter the blood. Lymphoma and multiple myeloma are cancers that begin in the cells of the immune system. Central nervous system cancers are cancers that begin in the tissues of the brain and spinal cord.

In some embodiments of any of the aspects, the cancer is a primary cancer. In some embodiments of any of the aspects, the cancer is a malignant cancer. As used herein, the term "malignant" refers to a cancer in which a group of tumor cells display one or more of uncontrolled growth (i.e., division beyond normal limits), invasion (i.e., intrusion on and destruction of adjacent tissues), and metastasis (i.e., spread to other locations in the body via lymph or blood). As used herein, the term "metastasize" refers to the spread of cancer from one part of the body to another. A tumor formed by cells that have spread is called a "metastatic tumor" or a "metastasis." The metastatic tumor contains cells that are like those in the original (primary) tumor. As used herein, the term "benign" or "non-malignant" refers to tumors that may grow larger but do not spread to other parts of the body. Benign tumors are self-limited and typically do not invade or metastasize.

A "cancer cell" or "tumor cell" refers to an individual cell of a cancerous growth or tissue. A tumor refers generally to a swelling or lesion formed by an abnormal growth of cells, which may be benign, pre-malignant, or malignant. Most cancer cells form tumors, but some, e.g., leukemia, do not necessarily form tumors. For those cancer cells that form tumors, the terms cancer (cell) and tumor (cell) are used interchangeably.

As used herein the term "neoplasm" refers to any new and abnormal growth of tissue, e.g., an abnormal mass of tissue, the growth of which exceeds and is uncoordinated with that of the normal tissues. Thus, a neoplasm can be a benign neoplasm, premalignant neoplasm, or a malignant neoplasm.

A subject that has a cancer or a tumor is a subject having objectively measurable cancer cells present in the subject's body. Included in this definition are malignant, actively proliferative cancers, as well as potentially dormant tumors or micrometastases. Cancers which migrate from their original location and seed other vital organs can eventually lead to the death of the subject through the functional deterioration of the affected organs.

Examples of cancer include but are not limited to, carcinoma, lymphoma, blastoma, sarcoma, leukemia, basal cell carcinoma, biliary tract cancer; bladder cancer; bone cancer; brain and CNS cancer; breast cancer; cancer of the peritoneum; cervical cancer; choriocarcinoma; colon and rectum cancer; connective tissue cancer; cancer of the digestive system; endometrial cancer; esophageal cancer; eye cancer; cancer of the head and neck; gastric cancer (including gastrointestinal cancer); glioblastoma (GBM); hepatic carcinoma; hepatoma; intra-epithelial neoplasm; kidney or renal cancer; larynx cancer; leukemia; liver cancer; lung cancer (e.g., small-cell lung cancer, non-small cell lung cancer, adenocarcinoma of the lung, and squamous carcinoma of the lung); lymphoma including Hodgkin's and non-Hodgkin's lymphoma; melanoma; myeloma; neuroblastoma; oral cavity cancer (e.g., lip, tongue, mouth, and pharynx); ovarian cancer; pancreatic cancer; prostate cancer; retinoblastoma; rhabdomyosarcoma; rectal cancer; cancer of the respiratory system; salivary gland carcinoma; sarcoma; skin cancer; squamous cell cancer; stomach cancer; testicular cancer; thyroid cancer; uterine or endometrial cancer; cancer of the urinary system; vulval cancer; as well as other carcinomas and sarcomas; as well as B-cell lymphoma (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenstrom's Macroglobulinemia); chronic lymphocytic leukemia (CLL); acute lymphoblastic leukemia (ALL); Hairy cell leukemia; chronic myeloblastic leukemia; and post-transplant lymphoproliferative disorder (PTLD), as well as abnormal vascular proliferation associated with phakomatoses, edema (such as that associated with brain tumors), and Meigs' syndrome.

A "cancer cell" is a cancerous, pre-cancerous, or transformed cell, either in vivo, ex vivo, or in tissue culture, that has spontaneous or induced phenotypic changes that do not necessarily involve the uptake of new genetic material. Although transformation can arise from infection with a transforming virus and incorporation of new genomic nucleic acid, or uptake of exogenous nucleic acid, it can also arise spontaneously or following exposure to a carcinogen, thereby mutating an endogenous gene. Transformation/cancer is associated with, e.g., morphological changes, immortalization of cells, aberrant growth control, foci formation, anchorage independence, malignancy, loss of contact inhibition and density limitation of growth, growth factor or serum independence, tumor specific markers, invasiveness or metastasis, and tumor growth in suitable animal hosts such as nude mice.

In various embodiments, an immune cell (e.g., Treg) comprising a CAR polypeptide or CAR system can be used to treat an autoimmune disease. In some embodiments, an immune cell (e.g., T cell) comprising a CAR polypeptide or CAR system directed against an autoimmune disease-specific antigen can be used to treat an autoimmune disease. "Autoimmune disease" refers to a class of diseases in which a subject's own antibodies react with host tissue or in which immune effector T cells are autoreactive to endogenous self-peptides and cause destruction of tissue. Thus an immune response is mounted against a subject's own antigens, referred to as self-antigens. A "self-antigen" as used herein refers to an antigen of a normal host tissue. Normal host tissue does not include neoplastic cells.

Autoantigens, as used herein, are endogenous proteins or fragments thereof that elicit this pathogenic immune response. Autoantigen can be any substance or a portion thereof normally found within a mammal that, in an autoimmune disease, becomes the primary (or a primary) target of attack by the immune system. The term also includes antigenic substances that induce conditions having the characteristics of an autoimmune disease when administered to mammals. Additionally, the term includes peptic subclasses consisting essentially of immunodominant epitopes or immunodominant epitope regions of autoantigens. Immunodominant epitopes or regions in induced autoimmune conditions are fragments of an autoantigen that can be used instead of the entire autoantigen to induce the disease. In humans afflicted with an autoimmune disease, immunodominant epitopes or regions are fragments of antigens specific to the tissue or organ under autoimmune attack and recognized by a substantial percentage (e.g. a majority though not necessarily an absolute majority) of autoimmune attack T-cells.

Autoantigens that are known to be associated with autoimmune disease include myelin proteins with demyelinating diseases, e.g. multiple sclerosis and experimental autoimmune myelitis; collagens and rheumatoid arthritis; insulin, proinsulin, glutamic acid decarboxylase 65 (GAD65); islet cell antigen (ICA512; ICA12) with insulin dependent diabetes.

A common feature in a number of autoimmune related diseases and inflammatory conditions is the involvement of pro-inflammatory CD4+ T cells. These T cells are responsible for the release of inflammatory, Th1 type cytokines. Cytokines characterized as Th1 type include interleukin 2 (IL-2), γ-interferon, TNFα and IL-12. Such pro-inflammatory cytokines act to stimulate the immune response, in many cases resulting in the destruction of autologous tissue. Cytokines associated with suppression of T cell response are the Th2 type, and include IL-10, IL-4 and TGF-β. It has been found that Th1 and Th2 type T cells may use the identical antigen receptor in response to an immunogen; in the former producing a stimulatory response and in the latter a suppressive response.

Provided herein is a method of treating an autoimmune disease, which comprises administering an effective amount of a CAR composition to a patient in need thereof. In one embodiment of any one of the methods described, the autoimmune disorder is selected from the group consisting of thyroiditis, type 1 diabetes mellitus, Hashimoto's thyroidits, Graves' disease, celiac disease, multiple sclerosis, Guillain-Barre syndrome, Addison's disease, and Raynaud's phenomenon, Goodpasture's disease, arthritis (rheumatoid arthritis such as acute arthritis, chronic rheumatoid arthritis, gout or gouty arthritis, acute gouty arthritis, acute immunological arthritis, chronic inflammatory arthritis, degenerative arthritis, type II collagen-induced arthritis, infectious arthritis, Lyme arthritis, proliferative arthritis, psoriatic arthritis, Still's disease, vertebral arthritis, and juvenile-onset rheumatoid arthritis, arthritis chronica progrediente, arthritis deformans, polyarthritis chronica primaria, reactive arthritis, and ankylosing spondylitis), inflammatory hyperproliferative skin diseases, psoriasis such as plaque psoriasis, gutatte psoriasis, pustular psoriasis, and psoriasis of the nails, atopy including atopic diseases such as hay fever and Job's syndrome, dermatitis including contact dermatitis, chronic contact dermatitis, exfoliative dermatitis, allergic dermatitis, allergic contact dermatitis, dermatitis herpetiformis, nummular dermatitis, seborrheic dermatitis, non-specific dermatitis, primary irritant contact dermatitis, and atopic dermatitis, x-linked hyper IgM syndrome, allergic intraocular inflammatory diseases, urticaria such as chronic allergic urticaria and chronic idiopathic urticaria, including chronic autoimmune urticaria, myositis, polymyositis/dermatomyositis, juvenile dermatomyositis, toxic epidermal necrolysis, scleroderma (including systemic scleroderma), sclerosis such as systemic sclerosis, multiple sclerosis (MS) such as spino-optical MS, primary progressive MS (PPMS), and relapsing remitting MS (RRMS), progressive systemic sclerosis, atherosclerosis, arteriosclerosis, sclerosis disseminata, ataxic sclerosis, neuromyelitis optica (NMO), inflammatory bowel disease (IBD) (for example, Crohn's disease, autoimmune-mediated gastrointestinal diseases, colitis such as ulcerative colitis, colitis ulcerosa, microscopic colitis, collagenous colitis, colitis polyposa, necrotizing enterocolitis, and transmural colitis, and autoimmune inflammatory bowel disease), bowel inflammation, pyoderma gangrenosum, erythema nodosum, primary sclerosing cholangitis, respiratory distress syndrome, including adult or acute respiratory distress syndrome (ARDS), meningitis, inflammation of all or part of the uvea, iritis, choroiditis, an autoimmune hematological disorder, rheumatoid spondylitis, rheumatoid synovitis, hereditary angioedema, cranial nerve damage as in meningitis, herpes gestationis, pemphigoid gestationis, pruritis scroti, autoimmune premature ovarian failure, sudden hearing loss due to an autoimmune condition, IgE-mediated diseases such as anaphylaxis and allergic and atopic rhinitis, encephalitis such as Rasmussen's encephalitis and limbic and/or brainstem encephalitis, uveitis, such as anterior uveitis, acute anterior uveitis, granulomatous uveitis, non-granulomatous uveitis, phacoantigenic uveitis, posterior uveitis, or autoimmune uveitis, glomerulonephritis (GN) with and without nephrotic syndrome such as chronic or acute glomerulonephritis such as primary GN, immune-mediated GN, membranous GN (membranous nephropathy), idiopathic membranous GN or idiopathic membranous nephropathy, membrano- or membranous proliferative GN (MPGN), including Type I and Type II, and rapidly progressive GN, proliferative nephritis, autoimmune polyglandular endocrine failure, balanitis including balanitis circumscripta plasmacellularis, balanoposthitis, erythema annulare centrifugum, erythema dyschromicum perstans, eythema multiform, granuloma annulare, lichen nitidus, lichen sclerosus et atrophicus, lichen simplex chronicus, lichen spinulosus, lichen planus, lamellar ichthyosis, epidermolytic hyperkeratosis, premalignant keratosis, pyoderma gangrenosum, allergic conditions and responses, allergic reaction, eczema including allergic or atopic eczema, asteatotic eczema, dyshidrotic eczema, and vesicular palmoplantar eczema, asthma such as asthma bronchiale, bronchial asthma, and auto-immune asthma, conditions involving infiltration of T cells and chronic inflammatory responses, immune reactions against foreign antigens such as fetal A-B-O blood groups during pregnancy, chronic pulmonary inflammatory disease, autoimmune myocarditis, leukocyte adhesion deficiency, lupus, including lupus nephritis, lupus cerebritis, pediatric lupus, non-renal lupus, extra-renal lupus, discoid lupus and discoid lupus erythematosus, alopecia lupus, systemic lupus erythematosus (SLE) such as cutaneous SLE or subacute cutaneous SLE, neonatal lupus syndrome (NLE), and lupus erythematosus disseminatus, juvenile onset (Type I) diabetes mellitus, including pediatric insulin-dependent diabetes mellitus (IDDM), adult onset diabetes mellitus (Type II diabetes), autoimmune diabetes, idiopathic diabetes insipidus, diabetic retinopathy, diabetic nephropathy, diabetic large-artery disorder, immune responses associated with acute and delayed hypersensitivity mediated by cytokines and T-lymphocytes, sarcoidosis, granulomatosis including lymphomatoid granulomatosis, Wegener's granulomatosis, agranulocytosis, vasculitides, including vasculitis, large-vessel vasculitis (including polymyalgia rheumatica and giant-cell (Takayasu's) arteritis), medium-vessel vasculitis (including Kawasaki's disease and polyarteritis nodosa/periarteritis nodosa), microscopic polyarteritis, immunovasculitis, CNS vasculitis, cutaneous vasculitis, hypersensitivity vasculitis, necrotizing vasculitis such as systemic necrotizing vasculitis, and ANCA-associated vasculitis, such as Churg-Strauss vasculitis or syndrome (CSS) and ANCA-associated small-vessel vasculitis, temporal arteritis, autoimmune aplastic anemia, Coombs positive anemia, Diamond Blackfan anemia, hemolytic anemia or immune hemolytic anemia including autoimmune hemolytic anemia (AIHA), pernicious anemia (anemia perniciosa), Addison's disease, pure red cell anemia or aplasia (PRCA), Factor VIII deficiency, hemophilia A, autoimmune neutropenia, pancytopenia, leukopenia, diseases involving leukocyte diapedesis, CNS inflammatory disorders, multiple organ injury syndrome such as those secondary to septicemia, trauma or hemorrhage, antigen-antibody complex-mediated diseases, anti-glomerular basement membrane disease, anti-phospholipid antibody syndrome, allergic neuritis, Behcet's disease/syndrome, Castleman's syndrome, Goodpasture's syndrome, Reynaud's syndrome, Sjogren's syndrome, Stevens-Johnson syndrome, pemphigoid such as pemphigoid bullous and skin pemphigoid, pemphigus (including pemphigus vulgaris, pemphigus foliaceus, pemphigus mucus-membrane pemphigoid, and pemphigus erythematosus), autoimmune polyendocrinopathies, Reiter's disease or syndrome, an immune complex disorder such as immune complex nephritis, antibody-mediated nephritis, polyneuropathies, chronic neuropathy such as IgM polyneuropathies or IgM-mediated neuropathy, and autoimmune or immune-mediated thrombocytopenia such as idiopathic thrombocytopenic purpura (ITP) including chronic or acute ITP, scleritis such as idiopathic cerato-scleritis, episcleritis, autoimmune disease of the testis and ovary including autoimmune orchitis and oophoritis, primary hypothyroidism, hypoparathyroidism, autoimmune endocrine diseases including thyroiditis such as autoimmune thyroiditis, Hashimoto's disease, chronic thyroiditis (Hashimoto's thyroiditis), or subacute thyroiditis, idiopathic hypothyroidism, Grave's disease, polyglandular syndromes such as autoimmune polyglandular syndromes (or polyglandular endocrinopathy syndromes), paraneoplastic syndromes, including neurologic paraneoplastic syndromes such as Lambert-Eaton myasthenic syndrome or Eaton-Lambert syndrome, stiff-man or stiff-person syndrome, encephalomyelitis such as allergic encephalomyelitis or encephalomyelitis allergica and experimental allergic encephalomyelitis (EAE), myasthenia gravis such as thymoma-associated myasthenia gravis, cerebellar degeneration, neuromyotonia, opsoclonus or opsoclonus myoclonus syndrome (OMS), and sensory neuropathy, multifocal motor neuropathy, Sheehan's syndrome, autoimmune hepatitis, lupoid hepatitis, giant-cell hepatitis, autoimmune chronic active hepatitis, lymphoid interstitial pneumonitis (LIP), bronchiolitis obliterans (non-transplant) vs NSIP, Guillain-Barre syndrome, Berger's disease (IgA nephropathy), idiopathic IgA nephropathy, linear IgA dermatosis, acute febrile neutrophilic dermatosis, subcorneal pustular dermatosis, transient acantholytic dermatosis, cirrhosis such as primary biliary cirrhosis and pneumonocirrhosis, autoimmune enteropathy syndrome, Celiac or Coeliac disease, celiac sprue (gluten enteropathy), refractory sprue, idiopathic sprue, cryoglobulinemia, amylotrophic lateral sclerosis (ALS; Lou Gehrig's disease), coronary artery disease, autoimmune ear disease such as autoimmune inner ear disease (AIED), autoimmune hearing loss, polychondritis such as refractory or relapsed or relapsing polychondritis, pulmonary alveolar proteinosis, Cogan's syndrome/nonsyphilitic interstitial keratitis, Bell's palsy, Sweet's disease/syndrome, rosacea autoimmune, zoster-associated pain, amyloidosis, a non-cancerous lymphocytosis, a primary lymphocytosis, which includes monoclonal B cell lymphocytosis (e.g., benign monoclonal gammopathy and monoclonal gammopathy of undetermined significance, MGUS), peripheral neuropathy, paraneoplastic syndrome, channelopathies including channelopathies of the CNS, autism, inflammatory myopathy, focal or segmental or focal segmental glomerulosclerosis (FSGS), endocrine opthalmopathy, uveoretinitis, chorioretinitis, autoimmune hepatological disorder, fibromyalgia, multiple endocrine failure, Schmidt's syndrome, adrenalitis, gastric atrophy, presenile dementia, demyelinating diseases such as autoimmune demyelinating diseases and chronic inflammatory demyelinating polyneuropathy, Dressler's syndrome, alopecia areata, alopecia totalis, CREST syndrome (calcinosis, Raynaud's phenomenon, esophageal dysmotility, sclerodactyly, and telangiectasia), male and female autoimmune infertility, e.g., due to anti-spermatozoan antibodies, mixed connective tissue disease, Chagas' disease, rheumatic fever, recurrent abortion, farmer's lung, erythema multiforme, post-cardiotomy syndrome, Cushing's syndrome, bird-fancier's lung, allergic granulomatous angiitis, benign lymphocytic angiitis, Alport's syndrome, alveolitis such as allergic alveolitis and fibrosing alveolitis, interstitial lung disease, transfusion reaction, Sampter's syndrome, Caplan's syndrome, endocarditis, endomyocardial fibrosis, diffuse interstitial pulmonary fibrosis, interstitial lung fibrosis, pulmonary fibrosis, idiopathic pulmonary fibrosis, cystic fibrosis, endophthalmitis, erythema elevatum et diutinum, erythroblastosis fetalis, eosinophilic faciitis, Shulman's syndrome, Felty's syndrome, cyclitis such as chronic cyclitis, heterochronic cyclitis, iridocyclitis (acute or chronic), or Fuch's cyclitis, Henoch-Schonlein purpura, SCID, sepsis, endotoxemia, post-vaccination syndromes, Evan's syndrome, autoimmune gonadal failure, Sydenham's chorea, post-streptococcal nephritis, thromboangitis ubiterans, thyrotoxicosis, tabes dorsalis, chorioiditis, giant-cell polymyalgia, chronic hypersensitivity pneumonitis, keratoconjunctivitis sicca, idiopathic nephritic syndrome, minimal change nephropathy, benign familial and ischemia-reperfusion injury, transplant organ reperfusion, retinal autoimmunity, aphthae, aphthous stomatitis, arteriosclerotic disorders, aspermiogenesis, autoimmune hemolysis, Boeck's disease, enteritis allergica, erythema nodosum leprosum, idiopathic facial paralysis, chronic fatigue syndrome, febris rheumatica, Hamman-Rich's disease, sensoneural hearing loss, ileitis regionalis, leucopenia, transverse myelitis, primary idiopathic myxedema, ophthalmia symphatica, polyradiculitis acuta, pyoderma gangrenosum, acquired splenic atrophy, vitiligo, toxic-shock syndrome, conditions involving infiltration of T cells, leukocyte-adhesion deficiency, immune responses associated with acute and delayed hypersensitivity mediated by cytokines and T-lymphocytes, diseases involving leukocyte diapedesis, multiple organ injury syndrome, antigen-antibody complex-mediated diseases, antiglomerular basement membrane disease, allergic neuritis, autoimmune polyendocrinopathies, oophoritis, primary myxedema, autoimmune atrophic gastritis, rheumatic diseases, mixed connective tissue disease, nephrotic syndrome, insulitis, polyendocrine failure, autoimmune polyglandular syndrome type I, adult-onset idiopathic hypoparathyroidism (AOIH), myocarditis, nephrotic syndrome, primary sclerosing cholangitis, acute or chronic sinusitis, ethmoid, frontal, maxillary, or sphenoid sinusitis, an eosinophil-related disorder such as eosinophilia, pulmonary infiltration eosinophilia, eosinophilia-myalgia syndrome, Loffler's syndrome, chronic eosinophilic pneumonia, tropical pulmonary eosinophilia, granulomas containing eosinophils, seronegative spondyloarthritides, polyendocrine autoimmune disease, sclerosing cholangitis, sclera, episclera, Bruton's syndrome, transient hypogammaglobulinemia of infancy, Wiskott-Aldrich syndrome, ataxia telangiectasia syndrome, angiectasis, autoimmune disorders associated with collagen disease, rheumatism, allergic hypersensitivity disorders, glomerulonephritides, reperfusion injury, ischemic re-perfusion disorder, lymphomatous tracheobronchitis, inflammatory dermatoses, dermatoses with acute inflammatory components, and autoimmune uveoretinitis (AUR).

For convenience, the meaning of some terms and phrases used in the specification, examples, and appended claims, are provided below. Unless stated otherwise, or implicit from context, the following terms and phrases include the meanings provided below. The definitions are provided to aid in describing particular embodiments, and are not intended to limit the claimed invention, because the scope of the invention is limited only by the claims. Unless otherwise defined, all technical and scientific terms used herein have the same meaning as commonly understood by one of ordinary skill in the art to which this invention belongs. If there is an apparent discrepancy between the usage of a term in the art and its definition provided herein, the definition provided within the specification shall prevail.

For convenience, certain terms employed herein, in the specification, examples and appended claims are collected here.

The terms "decrease", "reduced", "reduction", or "inhibit" are all used herein to mean a decrease by a statistically significant amount. In some embodiments, "reduce," "reduction" or "decrease" or "inhibit" typically means a decrease by at least 10% as compared to a reference level (e.g. the absence of a given treatment or agent) and can include, for example, a decrease by at least about 10%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 98%, at least about 99%, or more. As used herein, "reduction" or "inhibition" does not encompass a complete inhibition or reduction as compared to a reference level. "Complete inhibition" is a 100% inhibition as compared to a reference level. A decrease can be preferably down to a level accepted as within the range of normal, e.g., for an individual without a given disorder.

The terms "increased", "increase", "enhance", or "activate" are all used herein to mean an increase by a statically significant amount. In some embodiments, the terms "increased", "increase", "enhance", or "activate" can mean an increase of at least 10% as compared to a reference level, for example an increase of at least about 20%, or at least about 30%, or at least about 40%, or at least about 50%, or at least about 60%, or at least about 70%, or at least about 80%, or at least about 90% or up to and including a 100% increase or any increase between 10-100% as compared to a reference level, or at least about a 2-fold, or at least about a 3-fold, or at least about a 4-fold, or at least about a 5-fold or at least about a 10-fold increase, or any increase between 2-fold and 10-fold or greater as compared to a reference level. In the context of a marker or symptom, an "increase" is a statistically significant increase in such level.

As used herein, a "subject" means a human or animal. Usually the animal is a vertebrate such as a primate, rodent, domestic animal or game animal. Primates include chimpanzees, cynomolgus monkeys, spider monkeys, and macaques, e.g., Rhesus. Rodents include mice, rats, woodchucks, ferrets, rabbits and hamsters. Domestic and game animals include cows, horses, pigs, deer, bison, buffalo, feline species, e.g., domestic cat, canine species, e.g., dog, fox, wolf, avian species, e.g., chicken, emu, ostrich, and fish, e.g., trout, catfish and salmon. In some embodiments, the subject is a mammal, e.g., a primate, e.g., a human. The terms, "individual," "patient" and "subject" are used interchangeably herein.

Preferably, the subject is a mammal. The mammal can be a human, non-human primate, mouse, rat, dog, cat, horse, or cow, but is not limited to these examples. Mammals other than humans can be advantageously used as subjects that represent animal models of cancer. A subject can be male or female.

A subject can be one who has been previously diagnosed with or identified as suffering from or having a condition in need of treatment (e.g. cancer) or one or more complications related to such a condition, and optionally, have already undergone treatment for the disease or disorder (e.g., cancer) or the one or more complications related to the disease or disorder (e.g., cancer). Alternatively, a subject can also be one who has not been previously diagnosed as having the disease or disorder (e.g., cancer) or one or more complications related to the disease or disorder (e.g., cancer). For example, a subject can be one who exhibits one or more risk factors for the disease or disorder (e.g., cancer) or one or more complications related to the disease or disorder (e.g., cancer) or a subject who does not exhibit risk factors.

A "subject in need" of treatment for a particular condition can be a subject having that condition, diagnosed as having that condition, or at risk of developing that condition.

As used herein, the terms "protein" and "polypeptide" are used interchangeably to designate a series of amino acid residues, connected to each other by peptide bonds between the alpha-amino and carboxy groups of adjacent residues. The terms "protein", and "polypeptide" refer to a polymer of amino acids, including modified amino acids (e.g., phosphorylated, glycated, glycosylated, etc.) and amino acid analogs, regardless of its size or function. "Protein" and "polypeptide" are often used in reference to relatively large polypeptides, whereas the term "peptide" is often used in reference to small polypeptides, but usage of these terms in the art overlaps. The terms "protein" and "polypeptide" are used interchangeably herein when referring to a gene product and fragments thereof. Thus, exemplary polypeptides or proteins include gene products, naturally occurring proteins, homologs, orthologs, paralogs, fragments and other equivalents, variants, fragments, and analogs of the foregoing.

In the various embodiments described herein, it is further contemplated that variants (naturally occurring or otherwise), alleles, homologs, conservatively modified variants, and/or conservative substitution variants of any of the particular polypeptides described are encompassed. As to amino acid sequences, one of skill will recognize that individual substitutions, deletions or additions to a nucleic acid, peptide, polypeptide, or protein sequence which alters a single amino acid or a small percentage of amino acids in the encoded sequence is a "conservatively modified variant" where the alteration results in the substitution of an amino acid with a chemically similar amino acid and retains the desired activity of the polypeptide. Such conservatively modified variants are in addition to and do not exclude polymorphic variants, interspecies homologs, and alleles consistent with the disclosure.

A given amino acid can be replaced by a residue having similar physiochemical characteristics, e.g., substituting one aliphatic residue for another (such as Ile, Val, Leu, or Ala for one another), or substitution of one polar residue for another (such as between Lys and Arg; Glu and Asp; or Gln and Asn). Other such conservative substitutions, e.g., substitutions of entire regions having similar hydrophobicity characteristics, are well known. Polypeptides comprising conservative amino acid substitutions can be tested in any one of the assays described herein to confirm that a desired activity, e.g. function and specificity of a native or reference polypeptide is retained.

Amino acids can be grouped according to similarities in the properties of their side chains (in A. L. Lehninger, in Biochemistry, second ed., pp. 73-75, Worth Publishers, New York (1975)): (1) non-polar: Ala (A), Val (V), Leu (L), Ile (I), Pro (P), Phe (F), Trp (W), Met (M); (2) uncharged polar: Gly (G), Ser (S), Thr (T), Cys (C), Tyr (Y), Asn (N), Gln (Q); (3) acidic: Asp (D), Glu (E); (4) basic: Lys (K), Arg (R), His (H). Alternatively, naturally occurring residues can be divided into groups based on common side-chain properties: (1) hydrophobic: Norleucine, Met, Ala, Val, Leu, Ile; (2) neutral hydrophilic: Cys, Ser, Thr, Asn, Gln; (3) acidic: Asp, Glu; (4) basic: His, Lys, Arg; (5) residues that influence chain orientation: Gly, Pro; (6) aromatic: Trp, Tyr, Phe. Non-conservative substitutions will entail exchanging a member of one of these classes for another class. Particular conservative substitutions include, for example; Ala into Gly or into Ser; Arg into Lys; Asn into Gln or into His; Asp into Glu; Cys into Ser; Gln into Asn; Glu into Asp; Gly into Ala or into Pro; His into Asn or into Gln; Ile into Leu or into Val; Leu into Ile or into Val; Lys into Arg, into Gln or into Glu; Met into Leu, into Tyr or into Ile; Phe into Met, into Leu or into Tyr; Ser into Thr; Thr into Ser; Trp into Tyr; Tyr into Trp; and/or Phe into Val, into Ile or into Leu.

In some embodiments, the polypeptide described herein (or a nucleic acid encoding such a polypeptide) can be a functional fragment of one of the amino acid sequences described herein. As used herein, a "functional fragment" is a fragment or segment of a peptide which retains at least 50% of the wild-type reference polypeptide's activity according to the assays described below herein. A functional fragment can comprise conservative substitutions of the sequences disclosed herein. In some embodiments of any of the aspects, a polypeptide can comprise the first N-terminal amino acid methionine. In embodiments where a polypeptide does not comprise a first N-terminal methionine, it is understood that a variant of the polypeptide does comprise a first N-terminal methionine.

In some embodiments, the polypeptide described herein can be a variant of a sequence described herein. In some embodiments, the variant is a conservatively modified variant. Conservative substitution variants can be obtained by mutations of native nucleotide sequences, for example. A "variant," as referred to herein, is a polypeptide substantially homologous to a native or reference polypeptide, but which has an amino acid sequence different from that of the native or reference polypeptide because of one or a plurality of deletions, insertions or substitutions. Variant polypeptide-encoding DNA sequences encompass sequences that comprise one or more additions, deletions, or substitutions of nucleotides when compared to a native or reference DNA sequence, but that encode a variant protein or fragment thereof that retains activity. A wide variety of PCR-based site-specific mutagenesis approaches are known in the art and can be applied by the ordinarily skilled artisan.

A variant amino acid or DNA sequence can be at least 70%, at least 75%, at least 80%, at least 85%, at least 90%, at least 91%, at least 92%, at least 93%, at least 94%, at least 95%, at least 96%, at least 97%, at least 98%, at least 99%, or more, identical to a native or reference sequence. The degree of homology (percent identity) between a native and a mutant sequence can be determined, for example, by comparing the two sequences using freely available computer programs commonly employed for this purpose on the world wide web (e.g. BLASTp or BLASTn with default settings).

Alterations of the native amino acid sequence can be accomplished by any of a number of techniques known to one of skill in the art. Mutations can be introduced, for example, at particular loci by synthesizing oligonucleotides containing a mutant sequence, flanked by restriction sites enabling ligation to fragments of the native sequence. Following ligation, the resulting reconstructed sequence encodes an analog having the desired amino acid insertion, substitution, or deletion. Alternatively, oligonucleotide-directed site-specific mutagenesis procedures can be employed to provide an altered nucleotide sequence having particular codons altered according to the substitution, deletion, or insertion required. Techniques for making such alterations are very well established and include, for example, those disclosed by Walder et al. (Gene 42:133, 1986); Bauer et al. (Gene 37:73, 1985); Craik (BioTechniques, January 1985, 12-19); Smith et al. (Genetic Engineering: Principles and Methods, Plenum Press, 1981); and U.S. Pat. Nos. 4,518,584 and 4,737,462, which are herein incorporated by reference in their entireties. Any cysteine residue not involved in maintaining the proper conformation of the polypeptide also can be substituted, generally with serine, to improve the oxidative stability of the molecule and prevent aberrant crosslinking. Conversely, cysteine bond(s) can be added to the polypeptide to improve its stability or facilitate oligomerization.

As used herein, the term "nucleic acid" or "nucleic acid sequence" refers to any molecule, preferably a polymeric molecule, incorporating units of ribonucleic acid, deoxyribonucleic acid or an analog thereof. The nucleic acid can be either single-stranded or double-stranded. A single-stranded nucleic acid can be one nucleic acid strand of a denatured double-stranded DNA. Alternatively, it can be a single-stranded nucleic acid not derived from any double-stranded DNA. In one aspect, the nucleic acid can be DNA. In another aspect, the nucleic acid can be RNA. Suitable DNA can include, e.g., genomic DNA, cDNA, or vector DNA. Suitable RNA can include, e.g., mRNA.

The term "expression" refers to the cellular processes involved in producing RNA and proteins and as appropriate, secreting proteins, including where applicable, but not limited to, for example, transcription, transcript processing, translation and protein folding, modification and processing. Expression can refer to the transcription and stable accumulation of sense (e.g., mRNA) or antisense RNA derived from a nucleic acid fragment or fragments and/or to the translation of mRNA into a polypeptide.

As used herein, the term "detecting" or "measuring" refers to observing a signal from, e.g. a probe, label, or target molecule to indicate the presence of an analyte in a sample.

Any method known in the art for detecting a particular label moiety can be used for detection. Exemplary detection methods include, but are not limited to, spectroscopic, fluorescent, photochemical, biochemical, immunochemical, electrical, optical or chemical methods. In some embodiments of any of the aspects, measuring can be a quantitative observation.

In some embodiments of any of the aspects, a polypeptide, nucleic acid, or cell as described herein can be engineered. As used herein, "engineered" refers to the aspect of having been manipulated by the hand of man. For example, a polypeptide is considered to be "engineered" when at least one aspect of the polypeptide, e.g., its sequence, has been manipulated by the hand of man to differ from the aspect as it exists in nature. As is common practice and is understood by those in the art, progeny of an engineered cell are typically still referred to as "engineered" even though the actual manipulation was performed on a prior entity.

In some embodiments of any of the aspects, the CAR polypeptides described herein is exogenous. In some embodiments of any of the aspects, the CAR polypeptides described herein is ectopic. In some embodiments of any of the aspects, the CAR polypeptides described herein is not endogenous.

The term "exogenous" refers to a substance present in a cell other than its native source. The term "exogenous" when used herein can refer to a nucleic acid (e.g. a nucleic acid encoding a polypeptide) or a polypeptide that has been introduced by a process involving the hand of man into a biological system such as a cell or organism in which it is not normally found and one wishes to introduce the nucleic acid or polypeptide into such a cell or organism. Alternatively, "exogenous" can refer to a nucleic acid or a polypeptide that has been introduced by a process involving the hand of man into a biological system such as a cell or organism in which it is found in relatively low amounts and one wishes to increase the amount of the nucleic acid or polypeptide in the cell or organism, e.g., to create ectopic expression or levels. In contrast, the term "endogenous" refers to a substance that is native to the biological system or cell. As used herein, "ectopic" refers to a substance that is found in an unusual location and/or amount. An ectopic substance can be one that is normally found in a given cell, but at a much lower amount and/or at a different time. Ectopic also includes substance, such as a polypeptide or nucleic acid that is not naturally found or expressed in a given cell in its natural environment.

As described herein, an "antigen" is a molecule that is bound by a binding site on an antibody agent (e.g., extracellular binding domain). Typically, antigens are bound by antibody ligands and are capable of raising an antibody response in vivo. An antigen can be a polypeptide, protein, nucleic acid or other molecule or portion thereof. The term "antigenic determinant" refers to an epitope on the antigen recognized by an antigen-binding molecule, and more particularly, by the antigen-binding site of said molecule.

In some embodiments, a nucleic acid encoding a polypeptide as described herein (e.g. a CAR polypeptide) is comprised by a vector. In some of the aspects described herein, a nucleic acid sequence encoding a given polypeptide as described herein, or any module thereof, is operably linked to a vector. The term "vector", as used herein, refers to a nucleic acid construct designed for delivery to a host cell or for transfer between different host cells. As used herein, a vector can be viral or non-viral. The term "vector" encompasses any genetic element that is capable of replication when associated with the proper control elements and that can transfer gene sequences to cells. A vector can include, but is not limited to, a cloning vector, an expression vector, a plasmid, phage, transposon, cosmid, chromosome, virus, virion, etc.

In some embodiments of any of the aspects, the vector is recombinant, e.g., it comprises sequences originating from at least two different sources. In some embodiments of any of the aspects, the vector comprises sequences originating from at least two different species. In some embodiments of any of the aspects, the vector comprises sequences originating from at least two different genes, e.g., it comprises a fusion protein or a nucleic acid encoding an expression product which is operably linked to at least one non-native (e.g., heterologous) genetic control element (e.g., a promoter, suppressor, activator, enhancer, response element, or the like).

As used herein, the term "expression vector" refers to a vector that directs expression of an RNA or polypeptide from sequences linked to transcriptional regulatory sequences on the vector. The sequences expressed will often, but not necessarily, be heterologous to the cell. An expression vector may comprise additional elements, for example, the expression vector may have two replication systems, thus allowing it to be maintained in two organisms, for example in human cells for expression and in a prokaryotic host for cloning and amplification.

As used herein, the term "viral vector" refers to a nucleic acid vector construct that includes at least one element of viral origin and has the capacity to be packaged into a viral vector particle. The viral vector can contain the nucleic acid encoding a polypeptide as described herein in place of non-essential viral genes. The vector and/or particle may be utilized for the purpose of transferring any nucleic acids into cells either in vitro or in vivo. Numerous forms of viral vectors are known in the art. Non-limiting examples of a viral vector of this invention include an AAV vector, an adenovirus vector, a lentivirus vector, a retrovirus vector, a herpesvirus vector, an alphavirus vector, a poxvirus vector a baculovirus vector, and a chimeric virus vector.

It should be understood that the vectors described herein can, in some embodiments, be combined with other suitable compositions and therapies. In some embodiments, the vector is episomal. The use of a suitable episomal vector provides a means of maintaining the nucleotide of interest in the subject in high copy number extra chromosomal DNA thereby eliminating potential effects of chromosomal integration.

As used herein, the terms "treat," "treatment," "treating," or "amelioration" refer to therapeutic treatments, wherein the object is to reverse, alleviate, ameliorate, inhibit, slow down or stop the progression or severity of a condition associated with a disease or disorder, e.g. cancer. The term "treating" includes reducing or alleviating at least one adverse effect or symptom of a condition, disease or disorder associated with a the disease or disorder (e.g., cancer). Treatment is generally "effective" if one or more symptoms or clinical markers are reduced. Alternatively, treatment is "effective" if the progression of a disease is reduced or halted. That is, "treatment" includes not just the improvement of symptoms or markers, but also a cessation of, or at least slowing of, progress or worsening of symptoms compared to what would be expected in the absence of treatment. Beneficial or desired clinical results include, but are not limited to, alleviation of one or more symptom(s), diminishment of extent of disease, stabilized (i.e., not worsening) state of disease, delay or slowing of disease progression, amelioration or palliation of the disease state, remission (whether partial or total), and/or decreased mortality, whether detectable or undetectable. The term "treatment" of a disease also includes providing relief from the symptoms or side-effects of the disease (including palliative treatment).

As used herein, the term "pharmaceutical composition" refers to the active agent in combination with a pharmaceutically acceptable carrier e.g. a carrier commonly used in the pharmaceutical industry. The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio. In some embodiments of any of the aspects, a pharmaceutically acceptable carrier can be a carrier other than water. In some embodiments of any of the aspects, a pharmaceutically acceptable carrier can be a cream, emulsion, gel, liposome, nanoparticle, and/or ointment. In some embodiments of any of the aspects, a pharmaceutically acceptable carrier can be an artificial or engineered carrier, e.g., a carrier that the active ingredient would not be found to occur in or within nature.

As used herein, the term "administering," refers to the placement of a compound as disclosed herein into a subject by a method or route which results in at least partial delivery of the agent at a desired site. Pharmaceutical compositions comprising the compounds disclosed herein can be administered by any appropriate route which results in an effective treatment in the subject. In some embodiments, administration comprises physical human activity, e.g., an injection, act of ingestion, an act of application, and/or manipulation of a delivery device or machine. Such activity can be performed, e.g., by a medical professional and/or the subject being treated.

As used herein, "contacting" refers to any suitable means for delivering, or exposing, an agent to at least one cell. Exemplary delivery methods include, but are not limited to, direct delivery to cell culture medium, transfection, transduction, perfusion, injection, or other delivery method known to one skilled in the art. In some embodiments, contacting comprises physical human activity, e.g., an injection; an act of dispensing, mixing, and/or decanting; and/or manipulation of a delivery device or machine.

As used herein, the term "analog" refers to a substance that shares one or more particular structural features, elements, components, or moieties with a reference substance. Typically, an "analog" shows significant structural similarity with the reference substance, for example sharing a core or consensus structure, but also differs in certain discrete ways. In some embodiments, an analog is a substance that can be generated from the reference substance, e.g., by chemical manipulation of the reference substance.

The term "statistically significant" or "significantly" refers to statistical significance and generally means a two standard deviation (2SD) or greater difference.

Other than in the operating examples, or where otherwise indicated, all numbers expressing quantities of ingredients or reaction conditions used herein should be understood as modified in all instances by the term "about." The term "about" when used in connection with percentages can mean±1%.

As used herein, the term "comprising" means that other elements can also be present in addition to the defined elements presented. The use of "comprising" indicates inclusion rather than limitation.

The term "consisting of" refers to compositions, methods, and respective components thereof as described herein, which are exclusive of any element not recited in that description of the embodiment.

As used herein the term "consisting essentially of" refers to those elements required for a given embodiment. The term permits the presence of additional elements that do not materially affect the basic and novel or functional characteristic(s) of that embodiment of the invention.

As used herein, the term "corresponding to" refers to an amino acid or nucleotide at the enumerated position in a first polypeptide or nucleic acid, or an amino acid or nucleotide that is equivalent to an enumerated amino acid or nucleotide in a second polypeptide or nucleic acid. Equivalent enumerated amino acids or nucleotides can be determined by alignment of candidate sequences using degree of homology programs known in the art, e.g., BLAST.

As used herein, the term "specific binding" refers to a chemical interaction between two molecules, compounds, cells and/or particles wherein the first entity binds to the second, target entity with greater specificity and affinity than it binds to a third entity which is a non-target. In some embodiments, specific binding can refer to an affinity of the first entity for the second target entity which is at least 10 times, at least 50 times, at least 100 times, at least 500 times, at least 1000 times or greater than the affinity for the third non-target entity. A reagent specific for a given target is one that exhibits specific binding for that target under the conditions of the assay being utilized.

The singular terms "a," "an," and "the" include plural referents unless context clearly indicates otherwise. Similarly, the word "or" is intended to include "and" unless the context clearly indicates otherwise. Although methods and materials similar or equivalent to those described herein can be used in the practice or testing of this disclosure, suitable methods and materials are described below. The abbreviation, "e.g." is derived from the Latin exempli gratia, and is used herein to indicate a non-limiting example. Thus, the abbreviation "e.g." is synonymous with the term "for example."

Groupings of alternative elements or embodiments of the invention disclosed herein are not to be construed as limitations. Each group member can be referred to and claimed individually or in any combination with other members of the group or other elements found herein. One or more members of a group can be included in, or deleted from, a group for reasons of convenience and/or patentability. When any such inclusion or deletion occurs, the specification is herein deemed to contain the group as modified thus fulfilling the written description of all Markush groups used in the appended claims.

Unless otherwise defined herein, scientific and technical terms used in connection with the present application shall have the meanings that are commonly understood by those of ordinary skill in the art to which this disclosure belongs. It should be understood that this invention is not limited to the particular methodology, protocols, and reagents, etc., described herein and as such can vary. The terminology used herein is for the purpose of describing particular embodiments only, and is not intended to limit the scope of the present invention, which is defined solely by the claims. Definitions of common terms in immunology and molecular biology can be found in The Merck Manual of Diagnosis and Therapy, 20th Edition, published by Merck Sharp & Dohme Corp., 2018 (ISBN 0911910190, 978-0911910421); Robert S. Porter et al. (eds.), The Encyclopedia of Molecular Cell Biology and Molecular Medicine, published by Blackwell Science Ltd., 1999-2012 (ISBN 9783527600908); and Robert A. Meyers (ed.), Molecular Biology and Biotechnology: a Comprehensive Desk Reference, published by VCH Publishers, Inc., 1995 (ISBN 1-56081-569-8); Immunology by Werner Luttmann, published by Elsevier, 2006; Janeway's Immunobiology, Kenneth Murphy, Allan Mowat, Casey Weaver (eds.), W. W. Norton & Company, 2016 (ISBN 0815345054, 978-0815345053); Lewin's Genes XI, published by Jones & Bartlett Publishers, 2014 (ISBN-1449659055); Michael Richard Green and Joseph Sambrook, Molecular Cloning: A Laboratory Manual, 4th ed., Cold Spring Harbor Laboratory Press, Cold Spring Harbor, N.Y., USA (2012) (ISBN 1936113414); Davis et al., Basic Methods in Molecular Biology, Elsevier Science Publishing, Inc., New York, USA (2012) (ISBN 044460149X); Laboratory Methods in Enzymology: DNA, Jon Lorsch (ed.) Elsevier, 2013 (ISBN 0124199542); Current Protocols in Molecular Biology (CPMB), Frederick M. Ausubel (ed.), John Wiley and Sons, 2014 (ISBN 047150338X, 9780471503385), Current Protocols in Protein Science (CPPS), John E. Coligan (ed.), John Wiley and Sons, Inc., 2005; and Current Protocols in Immunology (CPI) (John E. Coligan, ADA M Kruisbeek, David H Margulies, Ethan M Shevach, Warren Strobe, (eds.) John Wiley and Sons, Inc., 2003 (ISBN 0471142735, 9780471142737), the contents of which are all incorporated by reference herein in their entireties.

One of skill in the art can readily identify a chemotherapeutic agent of use (e.g. see Physicians' Cancer Chemotherapy Drug Manual 2014, Edward Chu, Vincent T. DeVita Jr., Jones & Bartlett Learning; Principles of Cancer Therapy, Chapter 85 in Harrison's Principles of Internal Medicine, 18th edition; Therapeutic Targeting of Cancer Cells: Era of Molecularly Targeted Agents and Cancer Pharmacology, Chs. 28-29 in Abeloff's Clinical Oncology, 2013 Elsevier; and Fischer D S (ed): The Cancer Chemotherapy Handbook, 4th ed. St. Louis, Mosby-Year Book, 2003).

In some embodiments of any of the aspects, the disclosure described herein does not concern a process for cloning human beings, processes for modifying the germ line genetic identity of human beings, uses of human embryos for industrial or commercial purposes or processes for modifying the genetic identity of animals which are likely to cause them suffering without any substantial medical benefit to man or animal, and also animals resulting from such processes.

Other terms are defined herein within the description of the various aspects of the invention.

All patents and other publications; including literature references, issued patents, published patent applications, and co-pending patent applications; cited throughout this application are expressly incorporated herein by reference for the purpose of describing and disclosing, for example, the methodologies described in such publications that might be used in connection with the technology described herein. These publications are provided solely for their disclosure prior to the filing date of the present application. Nothing in this regard should be construed as an admission that the inventors are not entitled to antedate such disclosure by virtue of prior invention or for any other reason. All statements as to the date or representation as to the contents of these documents is based on the information available to the applicants and does not constitute any admission as to the correctness of the dates or contents of these documents.

The description of embodiments of the disclosure is not intended to be exhaustive or to limit the disclosure to the precise form disclosed. While specific embodiments of, and examples for, the disclosure are described herein for illustrative purposes, various equivalent modifications are possible within the scope of the disclosure, as those skilled in the relevant art will recognize. For example, while method steps or functions are presented in a given order, alternative embodiments may perform functions in a different order, or functions may be performed substantially concurrently. The teachings of the disclosure provided herein can be applied to other procedures or methods as appropriate. The various embodiments described herein can be combined to provide further embodiments. Aspects of the disclosure can be modified, if necessary, to employ the compositions, functions and concepts of the above references and application to provide yet further embodiments of the disclosure. Moreover, due to biological functional equivalency considerations, some changes can be made in protein structure without affecting the biological or chemical action in kind or amount. These and other changes can be made to the disclosure in light of the detailed description. All such modifications are intended to be included within the scope of the appended claims.

Specific elements of any of the foregoing embodiments can be combined or substituted for elements in other embodiments. Furthermore, while advantages associated with certain embodiments of the disclosure have been described in the context of these embodiments, other embodiments may also exhibit such advantages, and not all embodiments need necessarily exhibit such advantages to fall within the scope of the disclosure.

The technology described herein is further illustrated by the following examples which in no way should be construed as being further limiting.

Some embodiments of the technology described herein can be defined according to any of the following numbered paragraphs:

1. A polypeptide comprising:
   a. an extracellular binding domain;
   b. a transmembrane domain;
   c. at least one intracellular signaling domain; and
   d. a repressible protease.
2. The polypeptide of paragraph 1, wherein the repressible protease is located:
   a. between the transmembrane domain and the first intracellular signaling domain;
   b. between the first intracellular signaling domain and the second intracellular signaling domain; or
   c. between the second intracellular signaling domain and the third intracellular signaling domain.
3. The polypeptide of paragraph 1 or 2, wherein the repressible protease is hepatitis C virus (HCV) nonstructural protein 3 (NS3).
4. The polypeptide of any one of paragraphs 1-3, further comprising a cofactor for the repressible protease.
5. The polypeptide of paragraph 4, wherein the cofactor is an HSV NS4A domain.
6. The polypeptide of paragraph 5, wherein the HSV NS4A domain is adjacent and N-terminal to the repressible protease.
7. The polypeptide of any one of paragraphs 1-6, further comprising at least one protease cleavage site of the repressible protease.
8. The polypeptide of any one of paragraphs 1-7, wherein the repressible protease and the at least one protease cleavage site are physically linked to one another.
9. The polypeptide of any one of paragraphs 1-8, wherein the at least one protease cleavage site is located:

a. between the transmembrane domain and the first intracellular signaling domain;
b. between the first intracellular signaling domain and the second intracellular signaling domain; and/or
c. between the second intracellular signaling domain and the third intracellular signaling domain.

10. The polypeptide of paragraph 1-9, wherein the polypeptide is cleaved when a protease inhibitor is not bound to the repressible protease.

11. The polypeptide of any one of paragraphs 1-10, wherein the N-terminal amino acid of the cleaved polypeptide is associated with a high degradation rate and a low half-life.

12. The polypeptide of any one of paragraphs 1-11, in combination with a protease inhibitor bound to the repressible protease.

13. The polypeptide of any one of paragraphs 1-12, wherein the protease inhibitor is selected from grazoprevir (GZV), danoprevir, simeprevir, asunaprevir, ciluprevir, boceprevir, sovaprevir, paritaprevir, ombitasvir, paritaprevir, ritonavir, dasabuvir, and telaprevir.

14. The polypeptide of paragraph 1-13, wherein the polypeptide is not cleaved when the protease inhibitor is bound to the repressible protease.

15. The polypeptide of any one of paragraphs 1-14 comprising from the N-terminus to the C-terminus:
a. an extracellular binding domain;
b. a transmembrane domain;
c. at least one intracellular signaling domain;
d. a first protease cleavage site;
e. a repressible protease;
f. a second protease cleavage site; and
g. at least one intracellular signaling domain.

16. The polypeptide of any one of paragraphs 1-15 comprising from the N-terminus to the C-terminus:
a. an extracellular binding domain;
b. a transmembrane domain;
c. a first intracellular signaling domain;
d. a second intracellular signaling domain;
e. a first protease cleavage site;
f. a repressible protease;
g. a second protease cleavage site; and
h. a third intracellular signaling domain.

17. The polypeptide of any one of paragraphs 1-16 comprising from the N-terminus to the C-terminus:
a. an extracellular binding domain;
b. a transmembrane domain;
c. a first intracellular signaling domain;
d. a first protease cleavage site;
e. a repressible protease;
f. a second protease cleavage site;
g. a second intracellular signaling domain; and
h. a third intracellular signaling domain.

18. The polypeptide of any one of paragraphs 1-17 comprising from the N-terminus to the C-terminus:
a. an extracellular binding domain;
b. a transmembrane domain;
c. a first protease cleavage site;
d. a repressible protease;
e. a second protease cleavage site; and
f. at least one intracellular signaling domain.

19. The polypeptide of any one of paragraphs 1-18 comprising from the N-terminus to the C-terminus:
a. an extracellular binding domain;
b. a transmembrane domain;
c. a first protease cleavage site;
d. a repressible protease;
e. a second protease cleavage site;
f. a first intracellular signaling domain;
g. a second intracellular signaling domain; and
h. a third intracellular signaling domain.

20. The polypeptide of any one of paragraphs 1-19, wherein the at least one intracellular signaling domain comprises first and second intracellular signaling domains.

21. The polypeptide of any one of paragraphs 1-20, wherein the at least one intracellular signaling domain comprises first, second, and third intracellular signaling domains.

22. The polypeptide of any one of paragraphs 1-2 1, wherein each of the at least one intracellular signaling domains independently comprises an intracellular signaling domain selected from the group consisting of: TCRC; FcRy; FcRp; CD3zeta; CD3y; CD35; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-Ll); CD278 (ICOS); DAP10; LAT; KD2C SLP76; TRIM; ZAP70; and 41BB.

23. The polypeptide of any one of paragraphs 1-22, wherein the first, second, and third intracellular signaling domains comprise the intracellular signaling domains of CD28, 4-1BB, and CD3zeta, respectively.

24. The polypeptide of any one of paragraphs 1-23, wherein the transmembrane domain is located between the extracellular binding domain and the at least one intracellular signaling domain.

25. The polypeptide of any one of paragraphs 1-24, wherein the transmembrane domain comprises the transmembrane domain of CD28.

26. The polypeptide of any one of paragraphs 1-25, wherein the extracellular binding domain is an antibody, an antigen-binding fragment thereof, a F(ab) fragment, a F(ab') fragment, a single chain variable fragment (scFv), or a single-domain antibody (sdAb).

27. The polypeptide of any one of paragraphs 1-26, wherein the extracellular binding domain comprises a scFv.

28. The polypeptide of any one of paragraphs 1-27, wherein the extracellular binding domain specifically binds to a tumor antigen.

29. The polypeptide of any one of paragraphs 1-28, further comprising a leading peptide located N-terminal to the extracellular binding domain.

30. The polypeptide of paragraph 29, wherein the leading peptide is a CD8alpha leading peptide.

31. The polypeptide of any one of paragraphs 1-30, further comprising a spacer domain located between the extracellular binding domain and the transmembrane domain.

32. The polypeptide of paragraph 31, wherein the spacer domain comprises a CD8 hinge domain.

33. The polypeptide of any one of paragraphs 1-32, further comprising a first detectable marker adjacent to and C terminal of the extracellular binding domain.

34. The polypeptide of any one of paragraphs 1-33, further comprising a second detectable marker adjacent and N-terminal to the repressible protease.

35. The polypeptide of any one of paragraphs 1-34, further comprising a third detectable marker adjacent to and C-terminal to the repressible protease.

36. The polypeptide of any one of paragraphs 33-35, wherein the first, second, or third detectable marker is selected from GFP, V5, HA1, Myc, VSV-G, HSV, FLAG, HIS, mCherry, AU1, and biotin.

37. The polypeptide of any of paragraphs 1-36, wherein the polypeptide comprises one of SEQ ID NO: 34-36 or a sequence that is at least 70% identical to one of SEQ ID NO: 34-36 that maintains the same function.

38. A polypeptide comprising:
   a. an extracellular binding domain;
   b. a transmembrane domain;
   c. a repressible protease; and
   d. at least one intracellular signaling domain.
39. The polypeptide of paragraph 38, wherein the repressible protease is hepatitis C virus (HCV) nonstructural protein 3 (NS3).
40. The polypeptide of any one of paragraphs 38-39, further comprising a cofactor for the repressible protease.
41. The polypeptide of paragraph 40, wherein the cofactor is an HSV NS4A domain.
42. The polypeptide of paragraph 41, wherein the HSV NS4A domain is adjacent and N-terminal to the repressible protease.
43. The polypeptide of any one of paragraphs 38-42, further comprising at least one protease cleavage site of the repressible protease.
44. The polypeptide of any one of paragraphs 38-43, wherein the repressible protease and the at least one protease cleavage site are physically linked to one another.
45. The polypeptide of any one of paragraphs 38-44, wherein the repressible protease and at least one protease cleavage site are located in between the transmembrane domain and the intracellular signalling domain.
46. The polypeptide of any one of paragraphs 38-45 wherein the polypeptide is cleaved when a protease inhibitor is not bound to the repressible protease.
47. The polypeptide of any one of paragraphs 38-46, wherein the N-terminal amino acid of the cleaved polypeptide is associated with a high degradation rate and a low half-life.
48. The polypeptide of any one of paragraphs 38-47, in combination with a protease inhibitor bound to the repressible protease.
49. The polypeptide of any one of paragraphs 38-48, wherein the protease inhibitor is selected from grazoprevir (GZV), danoprevir, simeprevir, asunaprevir, ciluprevir, boceprevir, sovaprevir, paritaprevir, ombitasvir, paritaprevir, ritonavir, dasabuvir, and telaprevir.
50. The polypeptide of any one of paragraphs 38-49, wherein the polypeptide is not degraded when the protease inhibitor is bound to the repressible protease.
51. The polypeptide of any one of paragraphs 38-50, comprising from the N-terminus to the C-terminus:
   a. an extracellular binding domain;
   b. a transmembrane domain;
   c. a first protease cleavage site;
   d. a repressible protease;
   e. a second protease cleavage site; and
   f. a single intracellular signaling domain.
52. The polypeptide of any one of paragraphs 38-51, wherein the extracellular binding domain is an antibody, an antigen-binding fragment thereof, a F(ab) fragment, a F(ab') fragment, a single chain variable fragment (scFv), or a single-domain antibody (sdAb).
53. The polypeptide of any one of paragraphs 38-52, wherein the extracellular binding domain comprises a scFv.
54. The polypeptide of any one of paragraphs 38-53, wherein the extracellular binding domain specifically binds to a tumor antigen.
55. The polypeptide of any one of paragraphs 38-54, wherein the transmembrane domain is located between the extracellular binding domain and the intracellular signaling domain.
56. The polypeptide of any one of paragraphs 38-55, wherein the intracellular signaling domain comprises the intracellular signaling domain selected from TCRC; FcRy; FcRp; CD3zeta; CD3y; CD35; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-L1); CD278 (ICOS); DAP10; LAT; KD2C SLP76; TRIM; ZAP70; and 41BB.
57. The polypeptide of any one of paragraphs 38-56, wherein the intracellular signaling domain comprises the intracellular signaling domain of CD3zeta.
58. The polypeptide of any one of paragraphs 38-57, further comprising a leading peptide located N-terminal to the extracellular binding domain.
59. The polypeptide of paragraph 58, wherein the leading peptide is a CD8alpha leading peptide.
60. The polypeptide of any one of paragraphs 38-59, further comprising a spacer domain located between the extracellular binding domain and the transmembrane domain.
61. The polypeptide of paragraph 60, wherein the spacer domain comprises a CD8 hinge domain.
62. The polypeptide of any one of paragraphs 38-61, further comprising a first detectable marker adjacent to and C terminal of the extracellular binding domain.
63. The polypeptide of any one of paragraphs 38-62, further comprising a second detectable marker adjacent and N terminal to the repressible protease.
64. The polypeptide of any one of paragraphs 38-63, further comprising a third detectable marker adjacent to and C terminal to the repressible protease.
65. The polypeptide of any one of paragraphs 62-64, wherein the first, second, or third detectable marker is selected from GFP, V5, HA1, Myc, VSV-G, HSV, FLAG, HIS, AU1, mCherry, and biotin.
66. The polypeptide of any one of paragraphs 38-65, wherein the polypeptide comprises SEQ ID NO: 38 or a sequence that is at least 70% identical to SEQ ID NO: 38 that maintains the same function.
67. A polypeptide comprising:
   a. an extracellular binding domain;
   b. a transmembrane domain;
   c. at least one intracellular signaling domain; and
   d. a degron domain.
68. The polypeptide of paragraph 67, wherein the degron domain comprises a dihydrofolate reductase (DHFR) degron (DD) or a ligand-induced degradation (LID) domain.
69. The polypeptide of any one of paragraphs 67-68, in combination with a degron stabilizer bound to the degron domain.
70. The polypeptide of any one of paragraphs 67-69, wherein the degron is DHFR degron and the degron stabilizer is trimethoprim (TMP) or an analog thereof.
71. The polypeptide of any one of paragraphs 67-70, in combination with a degron destabilizer bound to the degron domain.
72. The polypeptide of any one of paragraphs 67-71, wherein the degron is a ligand-induced degradation (LID) domain and the degron destabilizer is Shield-1 or an analog thereof.

73. The polypeptide of any one of paragraphs 67-72, wherein the polypeptide is not degraded when the degron stabilizer is bound to the degron domain.
74. The polypeptide of any one of paragraphs 67-73, wherein the polypeptide is degraded when the degron destabilizer is bound to the degron domain.
75. The polypeptide of any one of paragraphs 67-74, comprising from the N-terminus to the C-terminus:
   a. an extracellular binding domain;
   b. a transmembrane domain;
   c. at least one intracellular signaling domain; and
   d. a degron domain.
76. The polypeptide of any one of paragraphs 67-75 wherein the extracellular binding domain is an antibody, an antigen-binding fragment thereof, a F(ab) fragment, a F(ab') fragment, a single chain variable fragment (scFv), or a single-domain antibody (sdAb).
77. The polypeptide of any one of paragraphs 67-76, wherein the extracellular binding domain comprises a scFv.
78. The polypeptide of any one of paragraphs 67-77, wherein the extracellular binding domain specifically binds to a tumor antigen.
79. The polypeptide of any one of paragraphs 67-78, wherein the transmembrane domain is located between the extracellular binding domain and the at least one intracellular signaling domain.
80. The polypeptide of any one of paragraphs 67-79, wherein each of the at least one intracellular signaling domains independently comprises an intracellular signaling domain selected from the group consisting of: TCRC; FcRy; FcRp; CD3zeta; CD3y; CD35; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-Ll); CD278 (ICOS); DAP10; LAT; KD2C SLP76; TRIM; ZAP70; and 41BB.
81. The polypeptide of any one of paragraphs 67-80, wherein the intracellular signaling domain comprises the intracellular signaling domain of CD28 and/or 4-1BB.
82. The polypeptide of any one of paragraphs 67-81, further comprising a leading peptide located N-terminal to the extracellular binding domain.
83. The polypeptide of paragraph 82, wherein the leading peptide is a CD8alpha leading peptide.
84. The polypeptide of any one of paragraphs 67-83, further comprising a spacer domain located between the extracellular binding domain and the transmembrane domain.
85. The polypeptide of paragraph 84, wherein the spacer domain comprises a CD8 hinge domain.
86. The polypeptide of any one of paragraphs 67-85, further comprising a detectable marker adjacent to and C terminal of the extracellular binding domain.
87. The polypeptide of paragraph 86, wherein the detectable marker is selected from GFP, V5, HA1, Myc, VSV-G, HSV, FLAG, HIS, AU1, mCherry, and biotin.
88. The polypeptide of any one of paragraphs 67-87, wherein the polypeptide comprises SEQ ID NO: 39 or a sequence that is at least 70% identical to SEQ ID NO: 39 that maintains the same function.
89. A system comprising a first polypeptide of any one of paragraphs 38-66 and a second polypeptide of any one of paragraphs 67-88.
90. The system of paragraph 89, wherein the system is functional only in the presence of the protease inhibitor and the degron stabilizer.
91. The system of paragraph 89, wherein the system is functional only in the presence of the protease inhibitor and the absence of the degron destabilizer.
92. The system of any one of paragraphs 89-9 1, wherein the first polypeptide comprises a signaling domain.
93. The system of paragraph 92, wherein the signaling domain comprises the signaling domain of CD3zeta.
94. The system of any one of paragraphs 89-93, wherein the second polypeptide comprises a co-stimulatory signaling domain.
95. The system of paragraph 94, wherein the co-stimulatory signaling domain comprises the co-stimulatory signaling domain of CD28 and/or 4-1BB.
96. The system of any one of paragraphs 89-95, wherein the first polypeptide and second polypeptide are physically linked to one another.
97. The system of any one of paragraphs 89-96, wherein the first polypeptide and second polypeptide flank a self-cleaving peptide domain.
98. A polypeptide comprising:
   a. an extracellular binding domain;
   b. a transmembrane domain; and
   c. a peptide domain.
99. The polypeptide of paragraph 98, wherein the peptide domain is specifically bound by a repressible protease.
100. The polypeptide of any one of paragraphs 98-99, wherein the peptide domain is specifically bound by NS3.
101. The polypeptide of any one of paragraphs 98-100, comprising from the N-terminus to the C-terminus:
   a. an extracellular binding domain;
   b. a transmembrane domain; and
   c. a peptide domain.
102. The polypeptide of any one of paragraphs 98-101, comprising from the N-terminus to the C-terminus:
   a. an extracellular binding domain;
   b. a transmembrane domain;
   c. at least one intracellular signaling domain; and
   d. a peptide domain.
103. The polypeptide of any one of paragraphs 98-102, comprising from the N-terminus to the C-terminus:
   a. an extracellular binding domain;
   b. a transmembrane domain;
   c. a single intracellular signaling domain; and
   d. a peptide domain.
104. The polypeptide of any one of paragraphs 98-103, comprising from the N-terminus to the C-terminus:
   a. an extracellular binding domain;
   b. a transmembrane domain;
   c. a first intracellular signaling domain;
   d. a second intracellular signaling domain; and
   e. a peptide domain.
105. The polypeptide of any one of paragraphs 98-104, wherein the extracellular binding domain is an antibody, an antigen-binding fragment thereof, a F(ab) fragment, a F(ab') fragment, a single chain variable fragment (scFv), or a single-domain antibody (sdAb).
106. The polypeptide of any one of paragraphs 98-105, wherein the extracellular binding domain comprises a scFv.
107. The polypeptide of any one of paragraphs 98-106, wherein the extracellular binding domain specifically binds to a tumor antigen.
108. The polypeptide of any one of paragraphs 98-107, wherein the transmembrane domain is located between the extracellular binding domain and the peptide domain.

109. The polypeptide of any one of paragraphs 98-108, further comprising at least one intracellular signaling domain.
110. The polypeptide of paragraph 109, wherein each of the at least one intracellular signaling domains independently comprises an intracellular signaling domain selected from the group consisting of: TCRC; FcRy; FcRp; CD3zeta; CD3y; CD35; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-L1); CD278 (ICOS); DAP10; LAT; KD2C SLP76; TRIM; ZAP70; and 41BB.
111. The polypeptide of any one of paragraphs 98-110, wherein the at least one intracellular signaling domain comprises the intracellular signaling domain of CD28 and/or 4-1BB.
112. The polypeptide of any one of paragraphs 98-111, further comprising a leading peptide located N-terminal to the extracellular binding domain.
113. The polypeptide of paragraph 112, wherein the leading peptide is a CD8alpha leading peptide.
114. The polypeptide of any one of paragraphs 98-113, further comprising a spacer domain located between the extracellular binding domain and the transmembrane domain.
115. The polypeptide of paragraph 114, wherein the spacer domain comprises a CD8 hinge domain.
116. The polypeptide of any one of paragraphs 98-115, further comprising a detectable marker adjacent to and C terminal of the extracellular binding domain.
117. The polypeptide of paragraph 116, wherein the detectable marker is selected from GFP, V5, HA1, Myc, VSV-G, HSV, FLAG, HIS, AU1, mCherry, and biotin.
118. The polypeptide of any one of paragraphs 98-117, wherein the polypeptide comprises SEQ ID NO: 84, SEQ ID NO: 85, or a sequence that is at least 70% identical to SEQ ID NO: 84 or SEQ ID NO: 85 that maintains the same function.
119. A polypeptide comprising:
   a. an extracellular domain;
   b. a transmembrane domain;
   c. a repressible protease; and
   d. at least one intracellular signaling domain.
120. The polypeptide of paragraph 119, wherein the repressible protease is hepatitis C virus (HCV) nonstructural protein 3 (NS3).
121. The polypeptide of any one of paragraphs 119-120, wherein the NS3 is catalytically dead.
122. The polypeptide of any one of paragraphs 119-121, wherein the polypeptide does not comprise any protease cleavage sites.
123. The polypeptide of any one of paragraphs 119-122, wherein the repressible protease is located:
   a. between the transmembrane domain and the at least one intracellular signaling domain;
   b. between the first intracellular signaling domain and the second intracellular signaling domain; or
   c. at the C terminus of the polypeptide.
124. The polypeptide of any one of paragraphs 119-123, in combination with a protease inhibitor bound to the repressible protease.
125. The polypeptide of any one of paragraphs 119-124, wherein the protease inhibitor is selected from grazoprevir (GZV), danoprevir, simeprevir, asunaprevir, cilupre-vir, boceprevir, sovaprevir, paritaprevir, ombitasvir, paritaprevir, ritonavir, dasabuvir, and telaprevir.
126. The polypeptide of any one of paragraphs 119-125, further comprising a cofactor for the repressible protease.
127. The polypeptide of any one of paragraphs 119-126, wherein the cofactor is an HSV NS4A domain.
128. The polypeptide of paragraph 127, wherein the HSV NS4A domain is adjacent and N-terminal to the repressible protease.
129. The polypeptide of any one of paragraphs 119-128, comprising from the N-terminus to the C-terminus:
   a. an extracellular domain;
   b. a transmembrane domain;
   c. at least one intracellular signaling domain;
   d. a repressible protease; and
   e. at least one intracellular signaling domain.
130. The polypeptide of any one of paragraphs 119-129, comprising from the N-terminus to the C-terminus:
   a. an extracellular domain;
   b. a transmembrane domain;
   c. a first intracellular signaling domain;
   d. a repressible protease; and
   e. a second intracellular signaling domain.
131. The polypeptide of any one of paragraphs 119-130, comprising from the N-terminus to the C-terminus:
   a. an extracellular domain;
   b. a transmembrane domain;
   c. at least one intracellular signaling domain; and
   d. a repressible protease.
132. The polypeptide of any one of paragraphs 119-131, comprising from the N-terminus to the C-terminus:
   a. an extracellular domain;
   b. a transmembrane domain;
   c. a first intracellular signaling domain;
   d. a second intracellular signaling domain; and
   e. a repressible protease.
133. The polypeptide of any one of paragraphs 119-132, comprising from the N-terminus to the C-terminus:
   a. an extracellular domain;
   b. a transmembrane domain;
   c. a single intracellular signaling domain; and
   d. a repressible protease.
134. The polypeptide of any one of paragraphs 119-133, comprising from the N-terminus to the C-terminus:
   a. an extracellular domain;
   b. a transmembrane domain;
   c. a repressible protease; and
   d. at least one intracellular signaling domain.
135. The polypeptide of any one of paragraphs 119-134, comprising from the N-terminus to the C-terminus:
   a. an extracellular domain;
   b. a transmembrane domain;
   c. a repressible protease; and
   d. a single intracellular signaling domain.
136. The polypeptide of any one of paragraphs 119-135, wherein the extracellular domain comprises the extracellular domain of DAP10.
137. The polypeptide of any one of paragraphs 119-136, wherein the transmembrane domain comprises the transmembrane domain of CD8.
138. The polypeptide of any one of paragraphs 119-137, wherein each of the at least one intracellular signaling domains independently comprises an intracellular signaling domain selected from the group consisting of: TCRC; FcRy; FcRp; CD3zeta; CD3y; CD35; CD3s; CD3C; CD22; CD79a; CD79b; CD66d; CARD11; CD2; CD7; CD27; CD28; CD30; CD40; CD54 (ICAM); CD83;

CD134 (OX40); CD137 (4-1BB); CD150 (SLAMF1); CD152 (CTLA4); CD223 (LAG3); CD270 (HVEM); CD273 (PD-L2); CD274 (PD-Ll); CD278 (ICOS); DAP10; LAT; KD2C SLP76; TRIM; ZAP70; and 41BB.

139. The polypeptide of any one of paragraphs 119-138, wherein the at least one intracellular signaling domain comprises the intracellular signaling domain of 4-1BB and/or CD3zeta.

140. The polypeptide of any one of paragraphs 119-139, further comprising at least one detectable marker at the C-terminal end of the polypeptide.

141. The polypeptide of paragraph 140, wherein the detectable marker is selected from GFP, V5, HA1, Myc, VSV-G, HSV, FLAG, HIS, AU1, mCherry, and biotin.

142. The polypeptide of any one of paragraphs 119-141, wherein the polypeptide comprises one of SEQ ID NOs: 86-89 or a sequence that is at least 70% identical to one of SEQ ID NOs: 86-89 that maintains the same function.

143. A system comprising a first polypeptide of any one of paragraphs 98-118 and a second polypeptide of any one of paragraphs 119-142.

144. The system of paragraph 143, wherein the second polypeptide specifically binds to the first polypeptide.

145. The system of any one of paragraphs 143-144, in combination with a protease inhibitor bound to the repressible protease of the second polypeptide.

146. The system of any one of paragraphs 143-145, wherein the protease inhibitor is selected from grazoprevir (GZV), danoprevir, simeprevir, asunaprevir, ciluprevir, boceprevir, sovaprevir, paritaprevir, ombitasvir, paritaprevir, ritonavir, dasabuvir, and telaprevir.

147. The system of any one of paragraphs 143-146, wherein the second polypeptide does not specifically bind the first polypeptide in the presence of the protease inhibitor.

148. The system of any one of paragraphs 143-147, wherein the first polypeptide comprises a co-stimulatory signaling domain.

149. The system of paragraph 148, wherein the co-stimulatory signaling domain comprises the co-stimulatory signaling domain of CD28 and/or 4-1BB.

150. The system of any one of paragraphs 143-149, wherein the second polypeptide comprises a signaling domain.

151. The system of paragraph 150, wherein the signaling domain comprises the signaling domain of CD3zeta.

152. The system of any one of paragraphs 143-151, wherein the first polypeptide and second polypeptide are physically linked to one another.

153. The system of any one of paragraphs 143-152, wherein the first polypeptide and second polypeptide flank a self-cleaving peptide domain.

154. The system of any one of paragraphs 143-153, wherein the system comprises one of SEQ ID NOs: 114-121 or a sequence that is at least 70% identical to one of SEQ ID NOs: 114-121 that maintains the same function.

155. A polypeptide comprising:
 a. an extracellular binding domain;
 b. a transmembrane domain; and
 c. a reader domain.

156. The polypeptide of paragraph 155, wherein the reader domain specifically binds to a repressible protease in the presence of a specific protease inhibitor.

157. The polypeptide of paragraph 155 or 156, wherein the reader domain is a danoprevir/NS3 complex reader domain (DNCR) or a grazoprevir/NS3 reader complex (GNCR) domain.

158. The polypeptide of any one of paragraphs 155-157, comprising from the N-terminus to the C-terminus:
 a. an extracellular binding domain;
 b. a transmembrane domain;
 c. a first intracellular signaling domain;
 d. a second intracellular signaling domain; and
 e. a reader domain.

159. The polypeptide of any one of paragraphs 155-158, comprising from the N-terminus to the C-terminus:
 a. an extracellular binding domain;
 b. a transmembrane domain;
 c. a single intracellular signaling domain; and
 d. and a reader domain.

160. The polypeptide of any one of paragraphs 157-159, further comprising at least one intracellular signaling domain.

161. The polypeptide of any one of paragraphs 157-160, wherein each of the at least one intracellular signaling domains independently comprises an intracellular signaling domain selected from the group consisting of: TCRC; FcRy; FcRp; CD3zeta; CD3y; CD35; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-Ll); CD278 (ICOS); DAP10; LAT; KD2C SLP76; TRIM; ZAP70; and 41BB.

162. The polypeptide of any one of paragraphs 157-161, wherein the at least one intracellular signaling domain comprises an intracellular signaling domain of CD28, and/or 4-1BB.

163. The polypeptide of any one of paragraphs 157-162, wherein the transmembrane domain is located between the extracellular binding domain and the at least one intracellular signaling domain.

164. The polypeptide of any one of paragraphs 157-163, wherein the transmembrane domain comprises the transmembrane domain of CD28.

165. The polypeptide of any one of paragraphs 157-164, wherein the extracellular binding domain is an antibody, an antigen-binding fragment thereof, a F(ab) fragment, a F(ab') fragment, a single chain variable fragment (scFv), or a single-domain antibody (sdAb).

166. The polypeptide of any one of paragraphs 157-165, wherein the extracellular binding domain comprises a scFv.

167. The polypeptide of any one of paragraphs 157-166, wherein the extracellular binding domain specifically binds to a tumor antigen.

168. The polypeptide of any one of paragraphs 157-167, further comprising a leading peptide located N-terminal to the extracellular binding domain.

169. The polypeptide of paragraph 168, wherein the leading peptide is a CD8alpha leading peptide.

170. The polypeptide of any one of paragraphs 157-169, further comprising a spacer domain located between the extracellular binding domain and the transmembrane domain.

171. The polypeptide of paragraph 170, wherein the spacer domain comprises a CD8 hinge domain.

172. The polypeptide of any one of paragraphs 157-171, further comprising a detectable marker adjacent to and C terminal of the extracellular binding domain.

173. The polypeptide of paragraph 172, wherein the detectable marker is selected from GFP, V5, HA1, Myc, VSV-G, HSV, FLAG, HIS, and biotin.

174. The polypeptide of any of paragraphs 157-173, wherein the polypeptide comprises residues 1-626 of SEQ ID NO: 90, residues 1-668 of SEQ ID NO: 91, residues 1-630 of SEQ ID NO: 92, residues 1-672 of SEQ ID NO: 93, residues 1-626 of SEQ ID NO: 127, residues 1-630 of SEQ ID NO: 128, or a sequence that is at least 70% identical to residues 1-626 of SEQ ID NO: 90, residues 1-668 of SEQ ID NO: 91, residues 1-630 of SEQ ID NO: 92, residues 1-672 of SEQ ID NO: 93, residues 1-626 of SEQ ID NO: 127, or residues 1-630 of SEQ ID NO: 128, that maintains the same function.

175. A polypeptide comprising:
   a. a repressible protease; and
   b. at least one intracellular signaling domain.
176. The polypeptide of paragraph 175, wherein the repressible protease is hepatitis C virus (HCV) nonstructural protein 3 (NS3).
177. The polypeptide of any one of paragraphs 175-176, wherein the NS3 is catalytically dead.
178. The polypeptide of any one of paragraphs 175-177, wherein the polypeptide does not comprise any protease cleavage sites.
179. The polypeptide of any one of paragraphs 175-178, further comprising a cofactor for the repressible protease.
180. The polypeptide of paragraph 179, wherein the cofactor is an HSV NS4A domain.
181. The polypeptide of paragraph 180, wherein the HSV NS4A domain is adjacent and N-terminal to the repressible protease.
182. The polypeptide of any one of paragraphs 175-181, in combination with a protease inhibitor bound to the repressible protease.
183. The polypeptide of paragraph 182, wherein the protease inhibitor is selected from grazoprevir (GZV), danoprevir, simeprevir, asunaprevir, ciluprevir, boceprevir, sovaprevir, paritaprevir, ombitasvir, paritaprevir, ritonavir, dasabuvir, and telaprevir.
184. The polypeptide of any one of paragraphs 175-183, comprising from the N-terminus to the C-terminus:
   a. an extracellular domain;
   b. a transmembrane domain;
   c. at least one intracellular signaling domain;
   d. a repressible protease; and
   e. at least one intracellular signaling domain.
185. The polypeptide of any one of paragraphs 175-184, comprising from the N-terminus to the C-terminus:
   a. an extracellular domain;
   b. a transmembrane domain;
   c. a first intracellular signaling domain;
   d. a repressible protease; and
   e. a second intracellular signaling domain.
186. The polypeptide of any one of paragraphs 175-185, further comprising an extracellular domain and a transmembrane domain.
187. The polypeptide of any one of paragraphs 175-186, wherein the extracellular domain comprises the extracellular domain of DAP10.
188. The polypeptide of any one of paragraphs 175-187, wherein the transmembrane domain comprises the transmembrane domain of CD8.
189. The polypeptide of any one of paragraphs 175-188, wherein each of the at least one intracellular signaling domains independently comprises an intracellular signaling domain selected from the group consisting of: TCRC; FcRy; FcRp; CD3zeta; CD3y; CD35; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-L1); CD278 (ICOS); DAP10; LAT; KD2C SLP76; TRIM; ZAP70; and 41BB.
190. The polypeptide of any one of paragraphs 175-189, wherein the intracellular signaling domain is the intracellular signaling domain of 4-1BB and/or CD3zeta.
191. The polypeptide of any one of paragraphs 175-190, further comprising at least one detectable marker at the C-terminal end of the polypeptide.
192. The polypeptide of paragraph 191, wherein the detectable marker is selected from GFP, V5, HA1, Myc, VSV-G, HSV, FLAG, HIS, AU1, mCherry, and biotin.
193. The polypeptide of any of paragraphs 175-192, wherein the polypeptide comprises one of SEQ ID NO: 86-89 or residues 648-1313 of SEQ ID NO: 90, residues 690-1355 of SEQ ID NO: 91, residues 652-1317 of SEQ ID NO: 92, residues 694-1359 of SEQ ID NO: 93, residues 648-1303 of SEQ ID NO: 127, or residues 652-1307 of SEQ ID NO: 128, or a sequence that is at least 70% identical to one of SEQ ID NO: 86-89 or residues 648-1313 of SEQ ID NO: 90, residues 690-1355 of SEQ ID NO: 91, residues 652-1317 of SEQ ID NO: 92, residues 694-1359 of SEQ ID NO: 93, residues 648-1303 of SEQ ID NO: 127, or residues 652-1307 of SEQ ID NO: 128 that maintains the same function.
194. A system comprising a first polypeptide of any one of paragraphs 155-174 and a second polypeptide of any one of paragraphs 119-142 or 175-193.
195. The system of paragraph 194, in combination with a protease inhibitor bound to the repressible protease of the second polypeptide.
196. The system of paragraph 194 or 195, wherein the protease inhibitor is selected from grazoprevir (GZV), danoprevir, simeprevir, asunaprevir, ciluprevir, boceprevir, sovaprevir, paritaprevir, ombitasvir, paritaprevir, ritonavir, dasabuvir, and telaprevir.
197. The system of any one of paragraphs 194-196, wherein the reader domain of the first polypeptide specifically binds to the repressible protease of the second polypeptide in the presence of a protease inhibitor; and/or the reader domain of the first polypeptide does not specifically bind to the repressible protease of the second polypeptide in the absence of the protease inhibitor specific to the reader domain.
198. The system of any one of paragraphs 194-197, wherein the first polypeptide comprises a co-stimulatory signaling domain.
199. The system of paragraph 198, wherein the co-stimulatory signaling domain comprises the co-stimulatory signaling domain of CD28 and/or 4-1BB.
200. The system of any one of paragraphs 194-199, wherein the second polypeptide comprises a signaling domain.
201. The system of paragraph 200, wherein the signaling domain comprises the signaling domain of CD3zeta.
202. The system of any one of paragraphs 194-201, wherein the first polypeptide and second polypeptide are physically linked to one another.
203. The system of any one of paragraphs 194-202, wherein the first polypeptide and second polypeptide flank a self-cleaving peptide domain.
204. The polypeptide of any one of paragraphs 194-203, wherein the polypeptide comprises SEQ ID NOs: 89-93 or 127-128 or a sequence that is at least 70% identical to SEQ ID NOs: 89-93 or 127-128 that maintains the same function.
205. A polynucleotide encoding the polypeptide or system of any one of paragraphs 1-204.

206. The polynucleotide of paragraph 205, wherein the polynucleotide comprises one of SEQ ID NO: 1-6, 60-69, 106-113, 125-126, or a sequence that is at least 70% identical to one of SEQ ID NO: 1-6, 60-69, 106-113, 125-126 that maintains the same function.

207. A vector comprising the polynucleotide of paragraph 205 or 206.

208. The vector of paragraph 207, wherein the vector comprises one of SEQ ID NOs: 236-261 or a sequence that is at least 70% identical to one of SEQ ID NOs: 236-261 that maintains the same function.

209. A cell or population thereof comprising the polypeptide or system of any one of paragraphs 1-204, the polynucleotide of any one of paragraphs 205-206, or the vector of any one of paragraphs 207-208.

210. The cell of paragraph 209, wherein the cell comprises an immune cell.

211. The cell of paragraph 210, wherein the immune cell comprises a CD4+ T cell, a CD8+ T cell, a regulatory T cell (Treg), or a natural killer (NK) cell.

212. The cell of any one of paragraphs 209-211, wherein the cell is a CD4+ T cell comprising the polypeptide of paragraphs 15 or 17.

213. The cell of any one of paragraphs 209-211, wherein the cell is a CD8+ T cell comprising the polypeptide of paragraphs 15 or 17.

214. The cell of any one of paragraphs 209-211, wherein the cell is a Treg comprising the polypeptide of paragraphs 15, 17, 18, or 19.

215. The cell of any one of paragraphs 209-211, wherein the cell is an NK cell comprising the polypeptide of paragraphs 18 or 19.

216. The cell of any one of paragraphs 209-215, further comprising an inactivating modification of at least one HLA Class I gene in the cell.

217. A pharmaceutical composition comprising the polypeptide or system of any one of paragraphs 1-204, the polynucleotide of any one of paragraphs 205-206, the vector of any one of paragraphs 207-208, or the cell of any one of paragraphs 216, and a pharmaceutically acceptable carrier.

218. A method of decreasing the degradation of a polypeptide, comprising the steps of:
 a. providing a population of cells comprising the polypeptide of any one of paragraphs 1-37; and
 b. contacting the population of cells with an effective amount of a protease inhibitor.

219. The method of paragraph 218, wherein the degradation is decreased by at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the protease inhibitor.

220. The method of any one of paragraphs 218-219, wherein the decrease in degradation results in an increase of activity of the polypeptide of at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the protease inhibitor.

221. The method of paragraph 220, wherein the increase of activity of the polypeptide comprises an increase in intracellular signaling of the intracellular signaling domains of the polypeptide.

222. The method of paragraph 221, wherein the increase in intracellular signaling results in an increase of activation of the population of cells.

223. The method of paragraph 223, wherein the activation of the population of cells comprises expression of activation markers comprising CD69 and/or expression of cytokines comprising IL-2 and IFNg.

224. The method of any one of paragraphs 222-223, wherein an increase of activation of the population of cells results in an increased killing efficiency of a target cell.

225. The method of any one of paragraphs 218-224, wherein the population of cells comprises immune cells.

226. The method of paragraph 225, wherein the population of immune cells comprises CD4+ T cells, CD8+ T cells, Tregs, or NK cells.

227. The method of any one of paragraphs 224-226, wherein the target cell expresses an antigen that binds to the extracellular binding domain of the polypeptide.

228. A method of treating a subject in need of a cell-based therapy comprising the steps of:
 a. administering to the subject a population of cells comprising the polypeptide of any one of paragraphs 1-37; and
 b. administering to the subject an effective amount of a protease inhibitor.

229. The method of paragraph 228, wherein the protease inhibitor is administered at the same time the population of cells is administered.

230. The method of paragraph 228 or 229, wherein the protease inhibitor is administered after the population of cells is administered.

231. The method of any one of paragraphs 228-230, wherein a withdrawal or decrease in concentration of the protease inhibitor results in increased degradation of the polypeptide.

232. The method of any one of paragraphs 228-231, wherein a withdrawal or decrease in concentration of the protease inhibitor results in decreased activity of the polypeptide.

233. The method of any one of paragraphs 228-232, wherein the subject has a cancer expressing an antigen that binds to the extracellular binding domain of the polypeptide.

234. A method of decreasing the degradation of a polypeptide, comprising the steps of:
 a. providing a population of cells comprising the polypeptide or system of any one of paragraphs 38-97; and
 b. contacting the population of cells with an effective amount of a protease inhibitor and/or an effective amount of a degron stabilizer.

235. The method of paragraph 234, wherein the degron is DHFR degron and the degron stabilizer is trimethoprim (TMP) or an analog thereof.

236. The method of paragraph 234 or 235, wherein the degradation is decreased by at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the protease inhibitor and/or degron stabilizer.

237. The method of any one of paragraphs 234-236, wherein the decrease in degradation results in an increase of activity of the polypeptide of at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the protease inhibitor and/or degron stabilizer.

238. The method of paragraph 237, wherein the increase of activity of the polypeptide comprises an increase in intracellular signaling of the intracellular signaling domains of the polypeptide.
239. The method of paragraph 238, wherein the increase in intracellular signaling results in an increase of activation of the population of cells.
240. The method of paragraph 239, wherein the activation of the population of cells comprises expression of activation markers comprising CD69 and/or expression of cytokines comprising IL-2 and IFNg.
241. The method of any one of paragraphs 239-240, wherein an increase of activation of the population of cells results in an increased killing efficiency of a target cell.
242. The method of any one of paragraphs 234-241, wherein the population of cells comprises immune cells.
243. The method of paragraph 242, wherein the population of immune cells comprises CD4+ T cells, CD8+ T cells, Tregs, or NK cells.
244. The method of any one of paragraphs 241-243, wherein the target cell expresses an antigen that binds to the extracellular binding domain of the first polypeptide of the system and an antigen that binds to the extracellular binding domain of the second polypeptide of the system.
245. A method of treating a subject in need of a cell-based therapy comprising the steps of:
  a. administering to the subject a population of cells comprising a polypeptide or system of any one of paragraphs 38-97; and
  b. administering to the subject an effective amount of a protease inhibitor and/or an effective amount of a degron stabilizer.
246. The method of paragraph 245, wherein the degron is DHFR degron and the degron stabilizer is trimethoprim (TMP) or an analog thereof.
247. The method of paragraph 245 or 246, wherein the protease inhibitor and/or degron stabilizer is administered at the same time the population of cells is administered.
248. The method of any one of paragraphs 245-247, wherein the protease inhibitor and/or degron stabilizer is administered after the population of cells is administered.
249. The method of any one of paragraphs 245-248, wherein a withdrawal or decrease in concentration of the protease inhibitor and/or degron stabilizer results in increased degradation of the polypeptide.
250. The method of any one of paragraphs 245-249, wherein a withdrawal or decrease in concentration of the protease inhibitor and/or degron stabilizer results in decreased activity of the polypeptide.
251. The method of any one of paragraphs 245-250, wherein the subject has a cancer expressing an antigen that binds to the extracellular binding domain of the first polypeptide of the system and an antigen that binds to the extracellular binding domain of the second polypeptide of the system.
252. A method of modulating the degradation of a polypeptide system, comprising the steps of:
  a. providing a population of cells comprising the polypeptide or system of any one of paragraphs 38-97;
  b. contacting the population of cells with an effective amount of a protease inhibitor to decrease the degradation of the polypeptide system; and
  c. contacting the population of cells with an effective amount of a degron destabilizer to increase the degradation of the polypeptide system.
253. The method of paragraph 252, wherein the degron is a ligand-induced degradation (LID) domain and the degron destabilizer is Shield-1 or an analog thereof.
254. The method of paragraph 252 or 253, wherein the degradation is decreased by at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the protease inhibitor.
255. The method of any one of paragraphs 252-254, wherein the decrease in degradation results in an increase of activity of the polypeptide of at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the protease inhibitor.
256. The method of paragraph 255, wherein the increase of activity of the polypeptide comprises an increase in intracellular signaling of the intracellular signaling domains of the polypeptide.
257. The method of paragraph 256, wherein the increase in intracellular signaling results in an increase of activation of the population of cells.
258. The method of paragraph 257, wherein the activation of the population of cells comprises expression of activation markers comprising CD69 and/or expression of cytokines comprising IL-2 and IFNg.
259. The method of any one of paragraphs 257-258, wherein an increase of activation of the population of cells results in an increased killing efficiency of a target cell.
260. The method of paragraph 252, wherein the degradation is increased by at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the degron destabilizer.
261. The method of paragraph 260, wherein the increase in degradation results in a decrease of activity of the polypeptide of at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the degron destabilizer.
262. The method of paragraph 261, wherein the decrease of activity of the polypeptide system comprises a decrease in intracellular signaling of the intracellular signaling domains of the polypeptide system.
263. The method of paragraph 262, wherein the decrease in intracellular signaling results in a decrease of activation of the population of cells.
264. The method of paragraph 263, wherein the activation of the population of cells comprises expression of activation markers comprising CD69 and/or expression of cytokines comprising IL-2 and IFNg.
265. The method of any one of paragraphs 263-264, wherein a decrease of activation of the population of cells results in a decreased killing efficiency of a target cell.
266. The method of any one of paragraphs 252-265, wherein the population of cells comprises immune cells.
267. The method of paragraph 266, wherein the population of immune cells comprises CD4+ T cells, CD8+ T cells, Tregs, or NK cells.
268. The method of any one of paragraphs 265-267, wherein the target cell expresses an antigen that binds to the extracellular binding domain of the first polypeptide of the system and an antigen that binds to the extracellular binding domain of the second polypeptide of the system.

269. A method of treating a subject in need of a cell-based therapy comprising the steps of:
   a. administering to the subject a population of cells comprising a polypeptide or system of any one of paragraphs 38-97;
   b. administering to the subject an effective amount of a protease inhibitor; and
   c. administering to the subject an effective amount of a degron destabilizer.
270. The method of paragraph 269, wherein the degron is a ligand-induced degradation (LID) domain and the degron destabilizer is Shield-1 or an analog thereof.
271. The method of paragraph 269 or 270, wherein the protease inhibitor is administered at the same time the population of cells is administered.
272. The method of any one of paragraphs 269-271, wherein the protease inhibitor is administered after the population of cells is administered.
273. The method of any one of paragraphs 269-272, wherein the degron destabilizer is administered after the population of cells is administered.
274. The method of any one of paragraphs 269-273, wherein an increase in concentration of the protease inhibitor results in increased activity of the polypeptide system.
275. The method of any one of paragraphs 269-274, wherein an increase in concentration of the degron destabilizer results in decreased activity of the polypeptide system.
276. The method of any one of paragraphs 269-275, wherein the subject has a cancer expressing an antigen that binds to the extracellular binding domain of the first polypeptide of the system and an antigen that binds to the extracellular binding domain of the second polypeptide of the system.
277. A method of decreasing the activity of a polypeptide system, comprising the steps of:
   a. providing a population of cells comprising the polypeptide or system of any one of paragraphs 98-154; and
   b. contacting the population of cells with an effective amount of a protease inhibitor.
278. The method of paragraph 277, wherein the activity is decreased by at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the protease inhibitor.
279. The method of paragraph 278, wherein the decrease of activity of the polypeptide system comprises a decrease in intracellular signaling of the intracellular signaling domains of the polypeptide system.
280. The method of paragraph 279, wherein the decrease in intracellular signaling results in a decrease of activation of the population of cells.
281. The method of paragraph 280, wherein the activation of the population of cells comprises expression of activation markers comprising CD69 and/or expression of cytokines comprising IL-2 and IFNg.
282. The method of any one of paragraphs 280-281, wherein a decrease of activation of the population of cells results in a decreased killing efficiency of a target cell.
283. The method of any one of paragraphs 277-282, wherein the population of cells comprises immune cells.
284. The method of paragraph 283, wherein the population of immune cells comprises CD4+ T cells, CD8+ T cells, Tregs, or NK cells.
285. The method of any one of paragraphs 282-284, wherein the target cell expresses an antigen that binds to the extracellular binding domain of the first polypeptide of the system.
286. A method of treating a subject in need of a cell-based therapy comprising the steps of:
   a. administering to the subject a population of cells comprising a polypeptide or system of any one of paragraphs 98-154; and
   b. administering to the subject an effective amount of a protease inhibitor.
287. The method of paragraph 286, wherein the protease inhibitor is administered at the same time the population of cells is administered.
288. The method of paragraph 286 or 287, wherein the protease inhibitor is administered after the population of cells is administered.
289. The method of any one of paragraphs 286-288, wherein an increase in concentration of the protease inhibitor results in decreased activity of the polypeptide system.
290. The method of any one of paragraphs 286-289, wherein the subject has a cancer expressing an antigen that binds to the extracellular binding domain of the polypeptide.
291. A method of increasing the activity of a polypeptide system, comprising the steps of:
   a. providing a population of cells comprising the polypeptide or system of any one of paragraphs 155-204; and
   b. contacting the population of cells with an effective amount of a protease inhibitor.
292. The method of paragraph 291, wherein the activity is increased by at least 10%, at least 20%, at least 30%, at least 40%, at least 50%, at least 60%, at least 70%, at least 80%, at least 90%, at least 100%, at least 200%, at least 300%, at least 400%, or at least 500% compared to prior to contacting with the protease inhibitor.
293. The method of paragraph 292, wherein the increase of activity of the polypeptide system comprises an increase in intracellular signaling of the intracellular signaling domains of the polypeptide system.
294. The method of paragraph 293, wherein the increase in intracellular signaling results in an increase of activation of the population of cells.
295. The method of paragraph 294, wherein the activation of the population of cells comprises expression of activation markers comprising CD69 and/or expression of cytokines comprising IL-2 and IFNg.
296. The method of any one of paragraphs 294-295, wherein an increase of activation of the population of cells results in an increased killing efficiency of a target cell.
297. The method of any one of paragraphs 291-296, wherein the population of cells comprises immune cells.
298. The method of paragraph 297, wherein the population of immune cells comprises CD4+ T cells, CD8+ T cells, Tregs, or NK cells.
299. The method of any one of paragraphs 291-298, wherein the target cell expresses an antigen that binds to the extracellular binding domain of the first polypeptide of the system.
300. A method of treating a subject in need of a cell-based therapy comprising the steps of:
   a. administering to the subject a population of cells comprising the polypeptide or system of any one of paragraphs 155-204; and
   b. administering to the subject an effective amount of a protease inhibitor.
301. The method of paragraph 300, wherein the protease inhibitor is administered at the same time the population of cells is administered.

302. The method of paragraph 300 or 301, wherein the protease inhibitor is administered after the population of cells is administered.
303. The method of any one of paragraphs 300-302, wherein an increase in concentration of the protease inhibitor results in increased activity of the polypeptide system.
304. The method of any one of paragraphs 300-303, wherein the subject has a cancer expressing an antigen that binds to the extracellular binding domain of the polypeptide.

Some embodiments of the technology described herein can be defined according to any of the following numbered paragraphs:

1. A polypeptide comprising:
   a. an extracellular binding domain;
   b. a transmembrane domain;
   c. at least one intracellular signaling domain; and
   d. a repressible protease.
2. The polypeptide of paragraph 1, wherein the repressible protease is located:
   a. between the transmembrane domain and the first intracellular signaling domain;
   b. between the first intracellular signaling domain and the second intracellular signaling domain; or
   c. between the second intracellular signaling domain and the third intracellular signaling domain.
3. The polypeptide of paragraph 1, further comprising a cofactor for the repressible protease and at least one protease cleavage site of the repressible protease.
4. The polypeptide of paragraph 3, wherein:
   a. the repressible protease is hepatitis C virus (HCV) nonstructural protein 3 (NS3);
   b. the cofactor is an HSV NS4A domain;
   c. the at least one protease cleavage site is located:
      i. between the transmembrane domain and the first intracellular signaling domain;
      ii. between the first intracellular signaling domain and the second intracellular signaling domain; and/or
      iii. between the second intracellular signaling domain and the third intracellular signaling domain; and/or
   d. the N-terminal amino acid of the cleaved polypeptide is associated with a high degradation rate and a low half-life.
5. The polypeptide of paragraph 1, in combination with a protease inhibitor bound to the repressible protease, wherein the protease inhibitor is selected from grazoprevir (GZV), danoprevir, simeprevir, asunaprevir, ciluprevir, boceprevir, sovaprevir, paritaprevir, ombitasvir, paritaprevir, ritonavir, dasabuvir, and telaprevir.
6. The polypeptide of paragraph 5, wherein the polypeptide is cleaved when a protease inhibitor is not bound to the repressible protease; and the polypeptide is not cleaved when the protease inhibitor is bound to the repressible protease.
7. The polypeptide of paragraph 1, comprising:
   a. a polypeptide comprising from the N-terminus to the C-terminus:
      i. an extracellular binding domain;
      ii. a transmembrane domain;
      iii. at least one intracellular signaling domain;
      iv. a first protease cleavage site;
      v. a repressible protease;
      vi. a second protease cleavage site; and
      vii. at least one intracellular signaling domain;
   b. a polypeptide comprising from the N-terminus to the C-terminus:
      i. an extracellular binding domain;
      ii. a transmembrane domain;
      iii. a first intracellular signaling domain;
      iv. a second intracellular signaling domain;
      v. a first protease cleavage site;
      vi. a repressible protease;
      vii. a second protease cleavage site; and
      viii. a third intracellular signaling domain;
   c. a polypeptide comprising from the N-terminus to the C-terminus:
      i. an extracellular binding domain;
      ii. a transmembrane domain;
      iii. a first intracellular signaling domain;
      iv. a first protease cleavage site;
      v. a repressible protease;
      vi. a second protease cleavage site;
      vii. a second intracellular signaling domain; and
      viii. a third intracellular signaling domain.
   d. a polypeptide comprising from the N-terminus to the C-terminus:
      i. an extracellular binding domain;
      ii. a transmembrane domain;
      iii. a first protease cleavage site;
      iv. a repressible protease;
      v. a second protease cleavage site; and
      vi. at least one intracellular signaling domain;
   e. a polypeptide comprising from the N-terminus to the C-terminus:
      i. an extracellular binding domain;
      ii. a transmembrane domain;
      iii. a first protease cleavage site;
      iv. a repressible protease;
      v. a second protease cleavage site;
      vi. a first intracellular signaling domain;
      vii. a second intracellular signaling domain; and
      viii. a third intracellular signaling domain; and/or
   f. a polypeptide comprising one of SEQ ID NO: 34-36 or a sequence that is at least 70% identical to one of SEQ ID NO: 34-36 that maintains the same function.
8. A system comprising:
   a. a first polypeptide comprising:
      i. an extracellular binding domain;
      ii. a transmembrane domain;
      iii. a repressible protease; and
      iv. at least one intracellular signaling domain; and
   b. a second polypeptide comprising:
      i. an extracellular binding domain;
      ii. a transmembrane domain;
      iii. at least one intracellular signaling domain; and
      iv. a degron domain.
9. The system of paragraph 8, wherein the first polypeptide further comprises a cofactor for the repressible protease and at least one protease cleavage site of the repressible protease.
10. The system of paragraph 9, wherein:
    a. the repressible protease is hepatitis C virus (HCV) nonstructural protein 3 (NS3);
    b. the cofactor is an HSV NS4A domain;
    c. the repressible protease and at least one protease cleavage site are located in between the transmembrane domain and the intracellular signalling domain of the first polypeptide; and/or
    d. the N-terminal amino acid of the cleaved polypeptide is associated with a high degradation rate and a low half-life.
11. The system of paragraph 8, wherein the degron domain comprises a dihydrofolate reductase (DHFR) degron (DD) or a ligand-induced degradation (LID) domain.

12. The system of paragraph 8, wherein the first polypeptide is in combination with:
    a. a protease inhibitor bound to the repressible protease, wherein the protease inhibitor is selected from grazoprevir (GZV), danoprevir, simeprevir, asunaprevir, ciluprevir, boceprevir, sovaprevir, paritaprevir, ombitasvir, paritaprevir, ritonavir, dasabuvir, and telaprevir;
    b. the second polypeptide is in combination with a degron stabilizer bound to the degron domain, wherein the degron is DHFR degron and the degron stabilizer is trimethoprim (TMP) or an analog thereof; and/or
    c. the second polypeptide is in combination with a degron destabilizer bound to the degron domain, wherein the degron is a ligand-induced degradation (LID) domain and the degron destabilizer is Shield-1 or an analog thereof.
13. The system of paragraph 12, wherein:
    a. the first polypeptide is cleaved when a protease inhibitor is not bound to the repressible protease;
    b. the first polypeptide is not cleaved when the protease inhibitor is bound to the repressible protease;
    c. the second polypeptide is degraded when the degron stabilizer is not bound to the degron domain;
    d. the second polypeptide is not degraded when the degron stabilizer is bound to the degron domain;
    e. the second polypeptide is degraded when the degron destabilizer is bound to the degron domain; and/or
    f. the second polypeptide is not degraded when the degron destabilizer is not bound to the degron domain.
14. The system of paragraph 8, wherein the first polypeptide comprises:
    a. a polypeptide comprising from the N-terminus to the C-terminus:
        i. an extracellular binding domain;
        ii. a transmembrane domain;
        iii. a first protease cleavage site;
        iv. a repressible protease;
        v. a second protease cleavage site; and
        vi. a single intracellular signaling domain; or
    b. a polypeptide comprising SEQ ID NO: 38 or a sequence that is at least 70% identical to SEQ ID NO: 38 that maintains the same function; and/or
    wherein the second polypeptide comprises from the N-terminus to the C-terminus:
    c. a polypeptide comprising from the N-terminus to the C-terminus:
        i. an extracellular binding domain;
        ii. a transmembrane domain;
        iii. at least one intracellular signaling domain; and
        iv. a degron domain; or
    d. a polypeptide comprising SEQ ID NO: 39 or a sequence that is at least 70% identical to SEQ ID NO: 39 that maintains the same function; and/or
    wherein the first polypeptide and second polypeptide are physically linked to one another and/or flank a self-cleaving peptide domain.
15. A system comprising:
    a. a first polypeptide comprising:
        i. an extracellular binding domain;
        ii. a transmembrane domain; and
        iii. a peptide domain; and
    b. a second polypeptide comprising:
        i. an extracellular domain;
        ii. a transmembrane domain;
        iii. a repressible protease; and
        iv. at least one intracellular signaling domain.
16. The system of paragraph 15, wherein the peptide domain is specifically bound by a repressible protease, optionally HCV NS3.
17. The system of paragraph 15, wherein the second polypeptide further comprises a cofactor for the repressible protease; and/or wherein the first or second polypeptides do not comprise a protease cleavage site.
18. The system of paragraph 17, wherein:
    a. the repressible protease is hepatitis C virus (HCV) nonstructural protein 3 (NS3);
    b. the repressible protease is catalytically dead;
    c. the cofactor is an HSV NS4A domain; and/or
    d. the repressible protease is located:
        i. between the transmembrane domain and the at least one intracellular signaling domain;
        ii. between the first intracellular signaling domain and the second intracellular signaling domain; or
        iii. at the C terminus of the polypeptide.
19. The system of paragraph 15, wherein the second polypeptide is in combination with a protease inhibitor bound to the repressible protease, wherein the protease inhibitor is selected from grazoprevir (GZV), danoprevir, simeprevir, asunaprevir, ciluprevir, boceprevir, sovaprevir, paritaprevir, ombitasvir, paritaprevir, ritonavir, dasabuvir, and telaprevir.
20. The system of paragraph 19, wherein:
    a. the repressible protease of the second polypeptide specifically binds the peptide domain of the first polypeptide in the absence of the protease inhibitor; and/or
    b. the repressible protease of the second polypeptide does not specifically bind the peptide domain of the first polypeptide in the presence of the protease inhibitor.
21. The system of paragraph 15, wherein the first polypeptide further comprises at least one intracellular signaling domain; and each of the at least one intracellular signaling domains of the first and/or second polypeptide independently comprises an intracellular signaling domain selected from the group consisting of: TCRC; FcRy; FcRp; CD3zeta; CD3y; CD35; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-Ll); CD278 (ICOS); DAP10; LAT; KD2C SLP76; TRIM; ZAP70; and 41BB.
22. The system of paragraph 15, wherein the first polypeptide comprises:
    a. a polypeptide comprising from the N-terminus to the C-terminus:
        i. an extracellular binding domain;
        ii. a transmembrane domain; and
        iii. a peptide domain;
    b. a polypeptide comprising from the N-terminus to the C-terminus:
        i. an extracellular binding domain;
        ii. a transmembrane domain;
        iii. at least one intracellular signaling domain; and
        iv. a peptide domain;
    c. a polypeptide comprising from the N-terminus to the C-terminus:
        i. an extracellular binding domain;
        ii. a transmembrane domain;
        iii. a single intracellular signaling domain; and
        iv. a peptide domain;

d. a polypeptide comprising from the N-terminus to the C-terminus:
   i. an extracellular binding domain;
   ii. a transmembrane domain;
   iii. a first intracellular signaling domain;
   iv. a second intracellular signaling domain; and
   v. a peptide domain;
e. a polypeptide comprising SEQ ID NO: 84, SEQ ID NO: 85, or a sequence that is at least 70% identical to SEQ ID NO: 84 or SEQ ID NO: 85 that maintains the same function; and/or wherein the second polypeptide comprises:

f. a polypeptide comprising from the N-terminus to the C-terminus:
   i. an extracellular domain;
   ii. a transmembrane domain;
   iii. at least one intracellular signaling domain;
   iv. a repressible protease; and
   v. at least one intracellular signaling domain;
g. a polypeptide comprising from the N-terminus to the C-terminus:
   i. an extracellular domain;
   ii. a transmembrane domain;
   iii. a first intracellular signaling domain;
   iv. a repressible protease; and
   v. a second intracellular signaling domain;
h. a polypeptide comprising from the N-terminus to the C-terminus:
   i. an extracellular domain;
   ii. a transmembrane domain;
   iii. at least one intracellular signaling domain; and
   iv. a repressible protease;
i. a polypeptide comprising from the N-terminus to the C-terminus:
   i. an extracellular domain;
   ii. a transmembrane domain;
   iii. a first intracellular signaling domain;
   iv. a second intracellular signaling domain; and
   v. a repressible protease;
j. a polypeptide comprising from the N-terminus to the C-terminus:
   i. an extracellular domain;
   ii. a transmembrane domain;
   iii. a single intracellular signaling domain; and
   iv. a repressible protease;
k. a polypeptide comprising from the N-terminus to the C-terminus:
   i. an extracellular domain;
   ii. a transmembrane domain;
   iii. a repressible protease; and
   iv. at least one intracellular signaling domain;
l. a polypeptide comprising from the N-terminus to the C-terminus:
   i. an extracellular domain;
   ii. a transmembrane domain;
   iii. a repressible protease; and
   iv. a single intracellular signaling domain; or
m. a polypeptide comprising one of SEQ ID NOs: 86-89 or a sequence that is at least 70% identical to one of SEQ ID NOs: 86-89 that maintains the same function; and/or wherein the first polypeptide and second polypeptide are physically linked to one another; flank a self-cleaving peptide domain; and/or comprise one of SEQ ID NOs: 114-121 or a sequence that is at least 70% identical to SEQ ID NO: 114-121 that maintains the same function.

23. A system comprising:
   a. a first polypeptide comprising:
      i. an extracellular binding domain;
      ii. a transmembrane domain; and
      iii. a reader domain; and
   b. a second polypeptide comprising:
      i. a repressible protease; and
      ii. at least one intracellular signaling domain.

24. The system of paragraph 23, wherein the reader domain specifically binds to a repressible protease in the presence of a specific protease inhibitor; and/or wherein the reader domain is a danoprevir/NS3 complex reader domain (DNCR) or a grazoprevir/NS3 reader complex (GNCR) domain.

25. The system of paragraph 23, wherein the second polypeptide further comprises a cofactor for the repressible protease; and/or wherein the first or second polypeptides do not comprise a protease cleavage site.

26. The system of paragraph 23, wherein:
   a. the repressible protease is hepatitis C virus (HCV) nonstructural protein 3 (NS3);
   b. the repressible protease is catalytically dead;
   c. the cofactor is an HSV NS4A domain; and/or
   d. the repressible protease is located:
      i. between the transmembrane domain and the at least one intracellular signaling domain;
      ii. between the first intracellular signaling domain and the second intracellular signaling domain; or
      iii. at the C terminus of the polypeptide.

27. The system of paragraph 23, wherein the second polypeptide is in combination with a protease inhibitor bound to the repressible protease, wherein the protease inhibitor is selected from grazoprevir (GZV), danoprevir, simeprevir, asunaprevir, ciluprevir, boceprevir, sovaprevir, paritaprevir, ombitasvir, paritaprevir, ritonavir, dasabuvir, and telaprevir.

28. The system of paragraph 27, wherein:
   a. the reader domain of the first polypeptide specifically binds to the repressible protease of the second polypeptide in the presence of the protease inhibitor specific to the reader domain; and/or
   b. the reader domain of the first polypeptide does not specifically bind to the repressible protease of the second polypeptide in the absence of the protease inhibitor specific to the reader domain.

29. The system of paragraph 23, wherein the first polypeptide further comprises at least one intracellular signaling domain; and each of the at least one intracellular signaling domains of the first and second polypeptide independently comprises an intracellular signaling domain selected from the group consisting of: TCRC; FcRy; FcRp; CD3zeta; CD3y; CD35; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-L1); CD278 (ICOS); DAP10; LAT; KD2C SLP76; TRIM; ZAP70; and 41BB.

30. The system of paragraph 23, wherein the first polypeptide comprises:
   a. a polypeptide comprising from the N-terminus to the C-terminus:
      i. an extracellular binding domain;
      ii. a transmembrane domain;
      iii. a first intracellular signaling domain;
      iv. a second intracellular signaling domain; and
      v. a reader domain;

b. a polypeptide comprising from the N-terminus to the C-terminus:
   i. an extracellular binding domain;
   ii. a transmembrane domain;
   iii. a single intracellular signaling domain; and
   iv. and a reader domain; or
c. a polypeptide comprising residues 1-626 of SEQ ID NO: 90, residues 1-668 of SEQ ID NO: 91, residues 1-630 of SEQ ID NO: 92, residues 1-672 of SEQ ID NO: 93, residues 1-626 of SEQ ID NO: 127, residues 1-630 of SEQ ID NO: 128, or a sequence that is at least 70% identical to residues 1-626 of SEQ ID NO: 90, residues 1-668 of SEQ ID NO: 91, residues 1-630 of SEQ ID NO: 92, residues 1-672 of SEQ ID NO: 93, residues 1-626 of SEQ ID NO: 127, or residues 1-630 of SEQ ID NO: 128, that maintains the same function; and/or wherein the second polypeptide comprises:
d. a polypeptide comprising from the N-terminus to the C-terminus:
   i. an extracellular domain;
   ii. a transmembrane domain;
   iii. at least one intracellular signaling domain;
   iv. a repressible protease; and
   v. at least one intracellular signaling domain;
e. a polypeptide comprising from the N-terminus to the C-terminus:
   i. an extracellular domain;
   ii. a transmembrane domain;
   iii. a first intracellular signaling domain;
   iv. a repressible protease; and
   v. a second intracellular signaling domain; or
f. a polypeptide comprising one of SEQ ID NO: 86-89 or residues 648-1313 of SEQ ID NO: 90, residues 690-1355 of SEQ ID NO: 91, residues 652-1317 of SEQ ID NO: 92, residues 694-1359 of SEQ ID NO: 93, residues 648-1303 of SEQ ID NO: 127, or residues 652-1307 of SEQ ID NO: 128, or a sequence that is at least 70% identical to one of SEQ ID NO: 86-89 or residues 648-1313 of SEQ ID NO: 90, residues 690-1355 of SEQ ID NO: 91, residues 652-1317 of SEQ ID NO: 92, residues 694-1359 of SEQ ID NO: 93, residues 648-1303 of SEQ ID NO: 127, or residues 652-1307 of SEQ ID NO: 128 that maintains the same function; and/or wherein the first polypeptide and second polypeptide are physically linked to one another; flank a self-cleaving peptide domain; and/or comprise one of SEQ ID NOs: 90-93 or 127-128 or a sequence that is at least 70% identical to SEQ ID NOs: 90-93 or 127-128 that maintains the same function.

EXAMPLES

Example 1

Control of Chimeric Antigen Receptor with Small Molecules

The transfer of chimeric antigen receptor (CAR)-expressing T cells to patients is a promising approach for cancer immunotherapy. This therapeutic approach is based on the genetic reprogramming of T cells with a synthetic immune receptor that directs them to destroy malignant cells. CARs typically consist of a single-chain antibody serving as the extracellular antigen-recognition domain, and signaling cytoplasmic domains to trigger the T cell activation (see e.g., FIG. 1A). CAR-expressing T cells targeted to CD 19 have shown success in curing leukemia in clinical trials, where up to 88% of patients achieved complete remission following treatment. While encouraging, T cell overactivity leading to cytokine release syndrome (CRS) is still a major issue to contend with in clinical practice. In severe cases of CRS, the uncontrolled immune response can lead to patient deaths.

The drug-inducible CAR design described herein addresses a major safety limitation in adoptive immunotherapy by providing a small molecule-controllable CAR system that can be used to regulate CAR activity. While several inducible switches are currently available, only a few of them are regulated by small molecules. Small molecules are cheaper and easier to administer, and are thus more advantageous than protein-based inducers. However, one of the available small molecule controllable CARs uses an analog of Rapamycin as the inducer, which has shown poor pharmacokinetics, thus limiting its utility in the clinic. The other system from BELLICUM PHARMACEUTICALS only partially controls signaling activity, and consequently has limited capability for regulating T cell activity. Furthermore, both of the small molecules involved in these technologies are not FDA-approved. Therefore, a small-molecule gated CAR with an FDA-approved drug inducer with a favorable toxicity profile and pharmacokinetics is highly desirable.

Due to promising clinical results, hundreds of CAR T cell therapies have been developed for treating a wide variety of disease indications. A major bottleneck to the development of CAR T cell therapy, however, is its potential devastating adverse side effect, which derailed JUNO THERAPEUTICS' lead CAR T candidate, JCR15. Therefore, to guard against such catastrophic failure, it is critical for companies to acquire safety control switch technology. Aware of this need, KITE PHARMA/GILEAD has recently purchased CELL DESIGN LAB—a company that develops a small-molecule gated CAR technology using an inducer that has serious stability issues. The switch described herein fills an important need in CAR T technology.

To control chimeric antigen receptor (CAR) activity, the non-structural protein (NS3) domain was incorporated into the structure of an CAR. The NS3 protease domain originates from the hepatitis C virus (HCV), and has been used in previous work in systems to control protein tagging and protein expression. In the absence of any drug, NS3 cleaves to excise itself at both the N and C termini. When a cell-permeable FDA-approved inhibitor (grazoprevir) is present, NS3 protease activity is blocked. Within a CAR molecule, the NS3 is placed between the membrane and the signaling domains or between the CD28 and CD3ζ (CD3zeta). When grazoprevir is absent, NS3 excises itself, cleaving the downstream domains in doing so. This truncated CAR molecule prevents the CAR from transducing any activation signal. In contrast, when grazoprevir is added, NS3 cleavage is blocked and the CAR remains intact for T cell signaling (see e.g., FIG. 1A).

Functionality in CD4+ and CD8+ T Cells

In designing the NS3 CAR, various configurations were created to determine how design affects CAR function. In each case, the inducible domain was directly fused to the receptor. As the NS3 protease functions by cleaving at both ends of the domain, the NS3 protease entity needed to be located within the CAR structure. To determine which configuration worked best for the NS3 CAR, the NS3 domain was placed after the CD8 hinge (V1), CD28 costimulatory domain (V2), or 4-1BB costimulatory domain (V3) of a third-generation CAR (see e.g., FIG. 1A). In each of these three versions, the CD3 domain is cleaved from the rest of the CAR unless the NS3 protease is inhibited by a drug. This allows for CD3 signaling to depend upon the presence of the inhibitor.

Figure 1B:
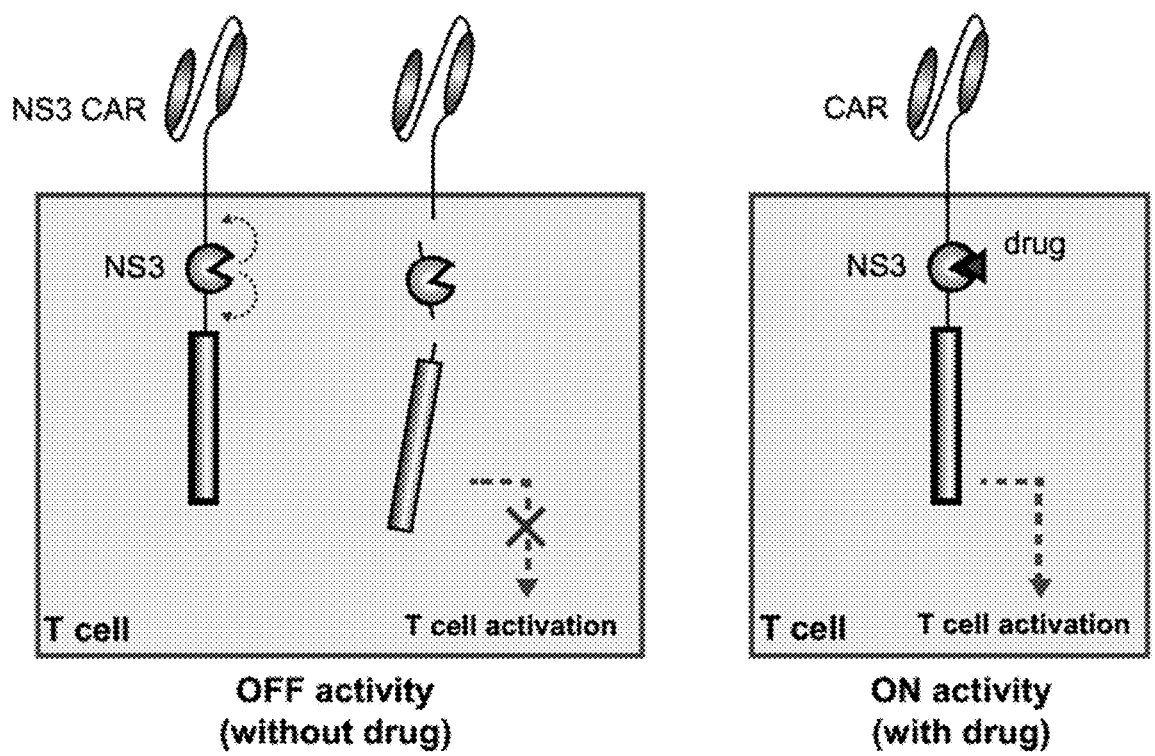
Figure 2A:
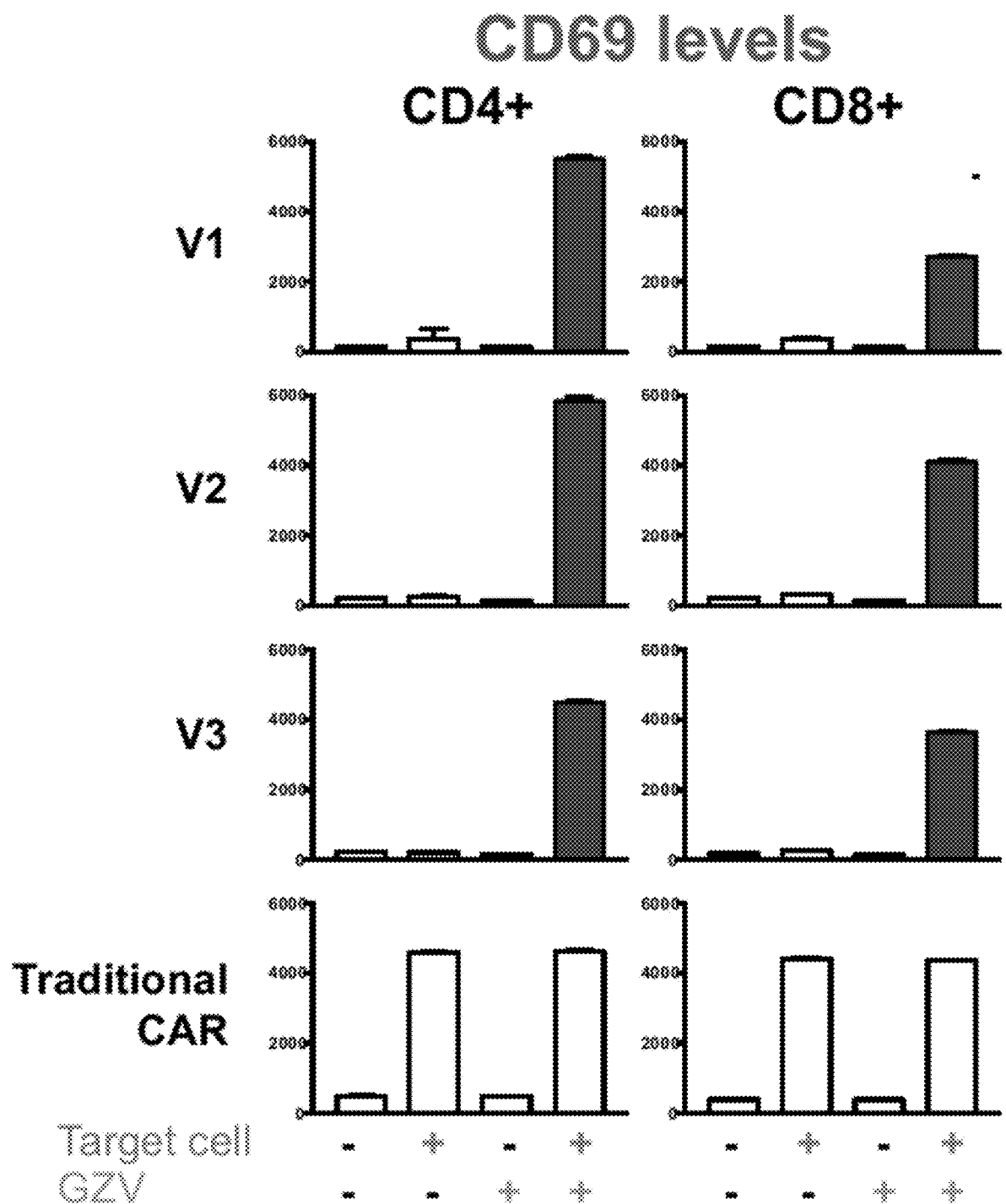
FIG. 2A-2B is a series of bar graphs.
Figure 2B:
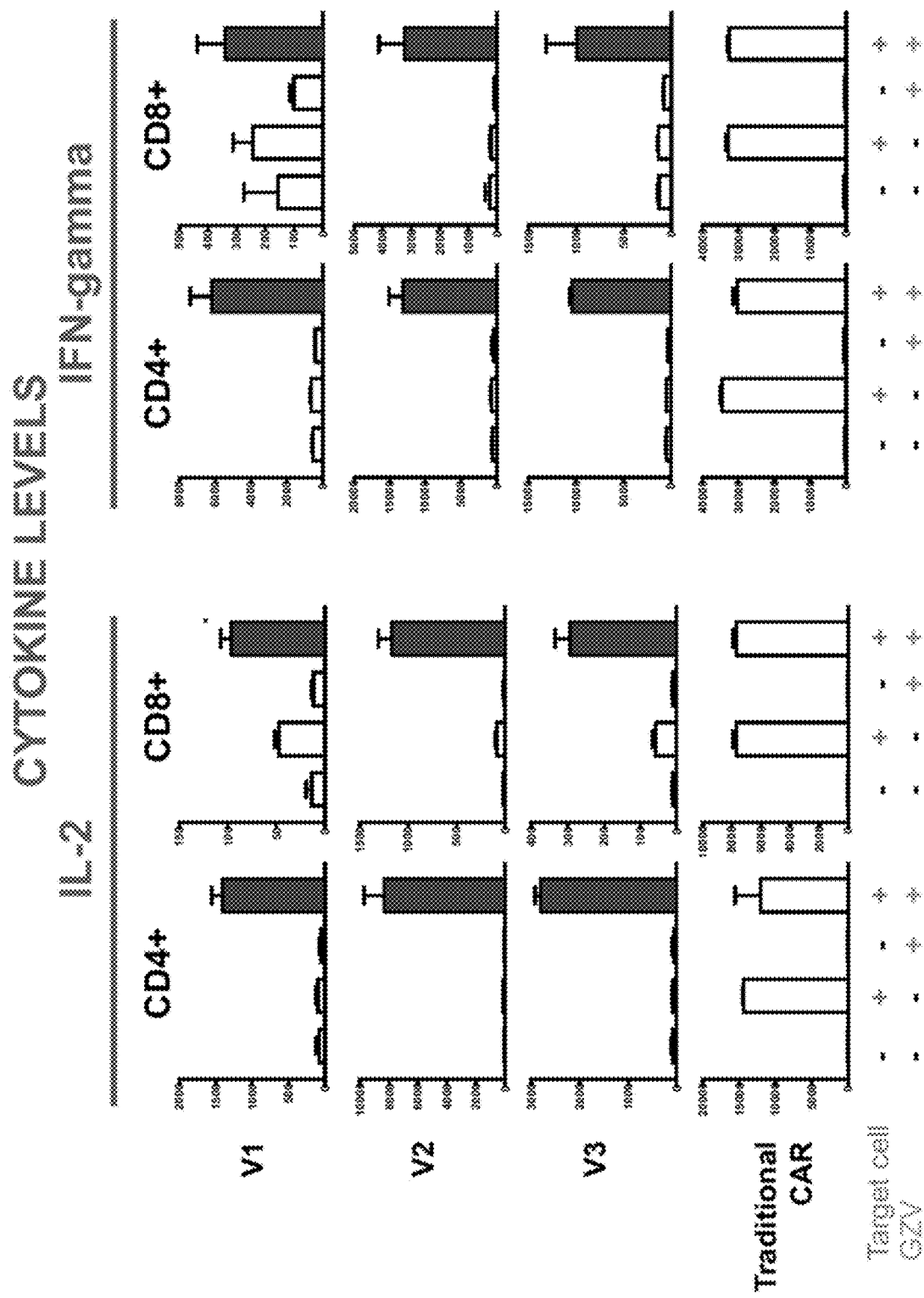
Figure 3A:
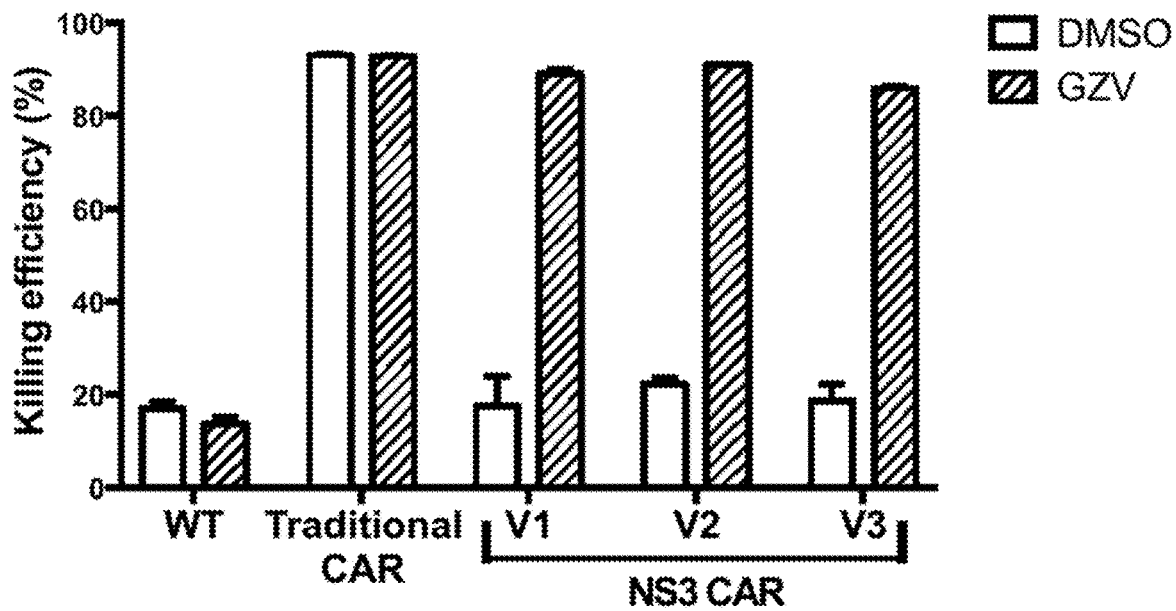
FIG. 3A-3B is a series of graphs.
Figure 3B:
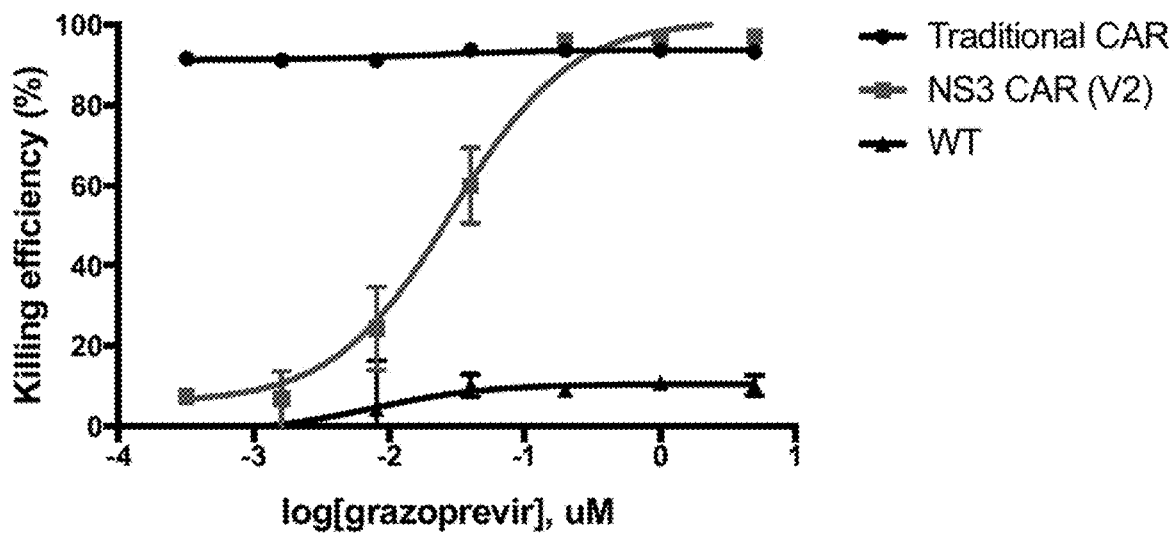

These CARs were introduced into human CD4+ and CD8+ primary T cells and tested for functionality by mixing with Her2+ target NALM cells. As a readout for NS3 CAR control over T cell activity, levels of CD69 (an early T cell activation marker) and cytokine release (indicative of downstream effector function) were measured. It is expected that in the absence of grazoprevir (an NS3 inhibitor), the CAR is dismantled, rendering it non-functional. Once grazoprevir is added, the full CAR is assembled, thus allowing the T cell to activate when Her2-expressing target cells are present (see e.g., FIG. 1B). CD69 levels indicated that all three versions of the CAR required both grazoprevir (NS3 inhibitor) and target cells to be active (see e.g., FIG. 2A). Furthermore, cytokine measurements of IL-2 and IFN-gamma, showed that CARs expressing V2 and V3 had their greatest cytokine release in the presence of grazoprevir and target cells. While V1 T cells also had their highest cytokine levels under this condition, their maximal levels were considerably lower than in cells expressing V2 or V3 (see e.g., FIG. 2B). In each case, the NS3 CARs were compared to traditional third-generation Her2 CAR, which showed no response to the NS3 inhibitor (see e.g., FIG. 2A-2B).

Cell Killing

To further evaluate the downstream effector function of NS3 CAR T cells, their cell killing abilities were tested. Her2-specific NS3 CAR CD8+ T cells were mixed with Her2-expressing NALM cells at a 1:1 ratio and the extent of cell killing determined. Results showed that all three versions of the NS3 CAR allowed for T cells to kill target NALM cells under the control of grazoprevir. Furthermore, the extent of cell killing was comparable to CD8+ T cells expressing the traditional Her2 CAR (see e.g., FIG. 3A).

By varying the dose of NS3 inhibitor, the level of CD8+ T cell-mediated killing could be modulated. To demonstrate this, CD8+ T cells expressing the V2 NS3 CAR were chosen as they indicated the highest levels of cytokine release. These cells were mixed with target NALM cells at a 1:1 ratio and the amount of NS3 inhibitor varied between 0 uM-5 uM. A positive correlation was observed between the level of inhibitor and cell killing ability of the T cells (see e.g., FIG. 3B).

Other Cell Types

Other than helper (CD4+) and cytotoxic (CD8+) T cells, the inducible NS3 CARs can be applied to other immune cell types. For example, CARs can suppress immune responses when introduced into regulatory T (Treg) cells. Treg cells are responsible for maintaining immune homeostasis and tolerance, and preventing autoimmunity. Due to their unique role in the immune system, Treg cells have been under investigation as therapeutic agents for treating autoimmune diseases, such as type 1 diabetes, or preventing organ transplant rejection.

The NS3 CAR was introduced into Treg cells to evaluate whether it can regulate suppressive behavior under the control of grazoprevir. First, Treg cell lines were generated expressing the V1 NS3 and V2 NS3 Her2-specific CARs (see e.g., FIG. 4A). Activating either V1 or V2 NS3 CARs on Treg cells by mixing these cells with Her2-expressing NALM cells resulted in the expression of CD69 (see e.g., FIG. 4B). Furthermore, to confirm the regulation of the suppressive ability of these NS3 CAR Treg cells by grazoprevir, V1 and V2 NS3 CAR Tregs were incubated with anti-CD 19 CAR-expressing CD4+ T cells and Her2+ NALM cells. CD4+ proliferation was evaluated by staining these cells with a fluorescent cell tracer and tracking proliferation following 6 days of incubation. The data showed that V1 and V2 NS3 CAR-Tregs were able to suppress CD4+ proliferation in a drug-dependent manner and their suppression efficiency was as high as that observed in Tregs that express a traditional CAR (see e.g., FIG. 4C).

Natural killer (NK) cells also represent a promising alternative to T cells for cancer immunotherapy. They display potent anti-tumor activity and exhibit little, if any, NK cell-related toxicity. Additionally, unlike engineered T cells that can lead to graft-vs-host disease, NK cells, which lack the TCR, are a potential candidate for generating "off-the-shelf" cellular therapy. To test whether the NS3 CAR can control NK cell activity, a simplified first-generation anti-Her2 NS3 CAR (see e.g., pHS241-ANDgate-NS3, SEQ ID NOs: 5, 38, 237) was expressed on NK-92MI cells and incubated with Her2-expressing NALM cells. Results showed that the addition of grazoprevir allowed for increased killing of the target cells, though high basal killing was observed in its absence (see e.g., FIG. 5A). This is likely due to high CAR expression levels, as flow cytometry data suggests that higher CAR levels correspond to higher basal killing (see e.g., FIG. 5B). IFN-gamma levels also indicated control over NK cell activity by grazoprevir (see e.g., FIG. 5C).

Previous literature has shown that the proximal placement of the CD28 domain to the transmembrane region of the CAR is sufficient for signaling through the CAR and activation of NK cells. Interestingly, the same observation was made in NK-92MI cells expressing V1 and V2 NS3 CARs (see e.g., FIG. 5A). When incubated with target cells, V2 CAR-expressing NK cells (where the CD28 domain was directly following the transmembrane region) indicated high basal killing in the absence of grazoprevir. When these two regions were split up with the NS3 domain, as in the V1 CAR, the basal killing was lowered. The same result was observed with cytokine release by measurement of IFN-gamma (see e.g., FIG. 5C). This suggests that the NS3 CAR can be applied to NK cells, though the design principles for CARs vary between immune cell types and must be taken into account.

Dual Molecule Tunable Logic AND Gates

Figure 6A:
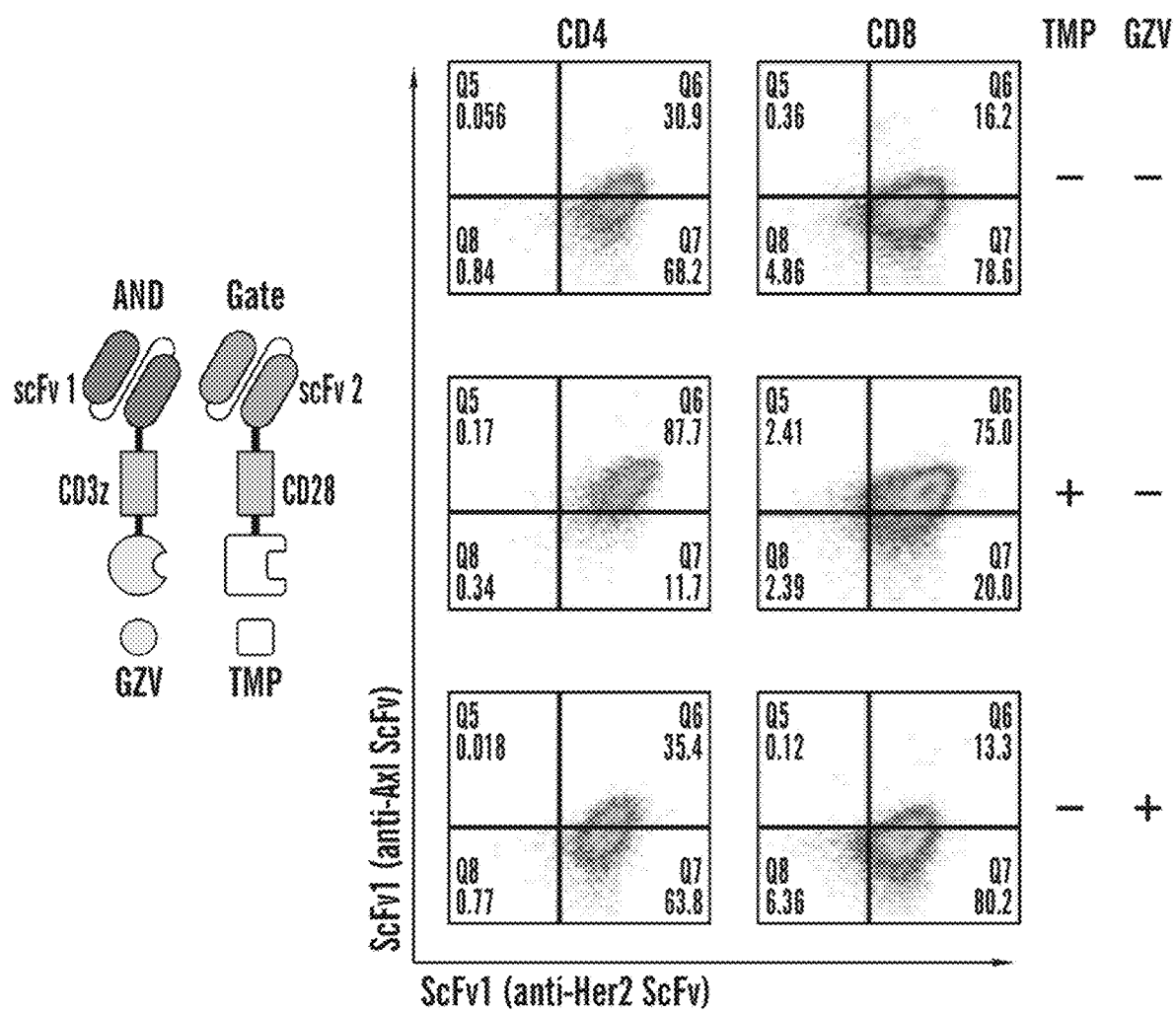
FIG. 6A-6C is a series of graphs showing the AND gate CAR construct.

Also described herein is a dual molecule tunable logic AND gates for enhancing targeting specificity of CAR-T cells, specifically a DD CAR, which contains a DHFR degron (DD) regulated by a second drug, to be used in conjunction with the NS3 CAR. Dihydrofolate reductase (DHFR) reduces dihydrofolate to tetrahydrofolate and is essential for *E. coli* replication and survival. TMP is an antibiotic that can bind to *E. coli* DHFR with a much higher affinity than its mammalian counterpart. Fusion of the engineered DHFR domain with a protein of interest destabilizes the protein, and when TMP binds to the DHFR domain it stabilizes the fusion protein, thus serving as an inducible protein expression system. Described herein is the generation of a combinatorial logic AND gate by distributing CAR intracellular signaling domains between two distinct scFvs with each signaling domain associated with either NS3 or DD. As shown in FIG. 6A, the AND gate CAR system comprised of a first receptor with the NS3 domain positioned between scFv1 and CD3z, and a second receptor with the DD positioned after scFv2-CD28, generating a functional dual-molecule controllable CAR-T cell.

Figure 6B:
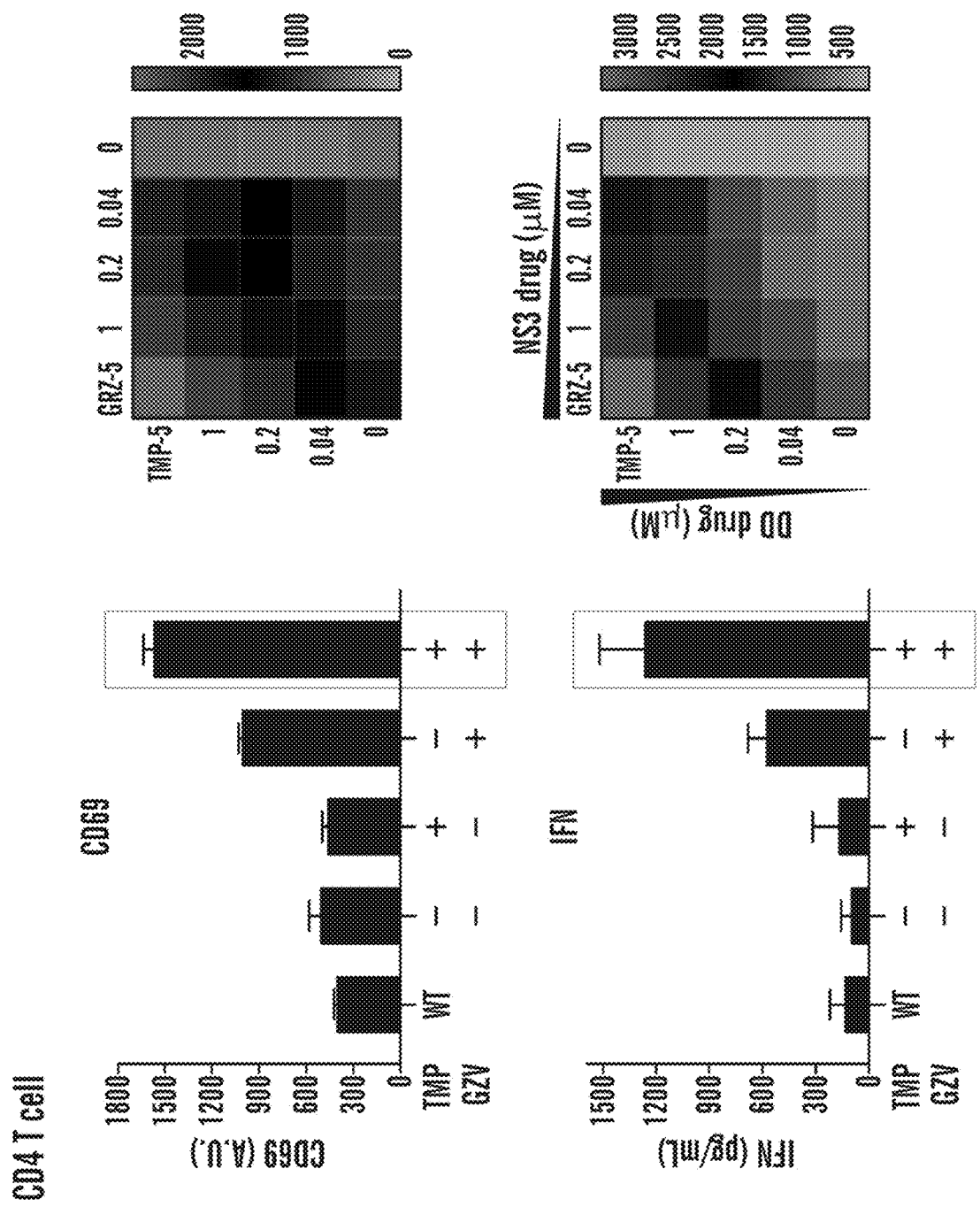
Figure 6C:
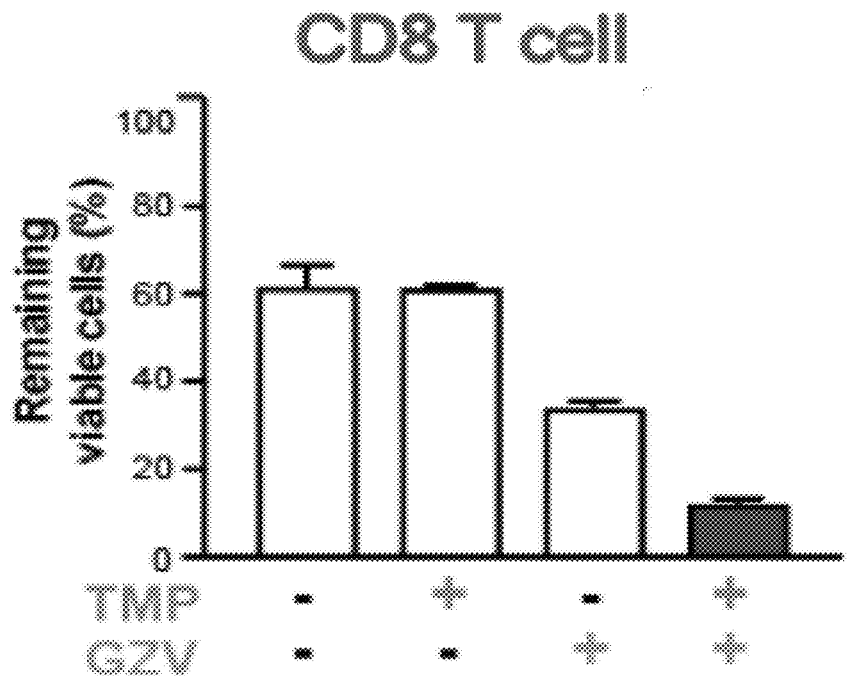

The NS3-DD CAR was generated by fusing a Her2-specific scFV with the NS3 domain, and an Axl-specific scFv with the DD. The drug tunability of this system was tested in CD4+ and CD8+ T cells. Unlike the NS3 cleavage mechanism, the DD destabilizes the whole protein of interest and leads it to proteasomal degradation. As such, the scFv-CD28 chain is stabilized on the cell surface only in the presence of TMP (see e.g., FIG. 6A). To test NS3-DD inducibility, Her2+/Axl+ NALM cells were co-cultured with CD4+ or CD8+ T cells at a 1:1 ratio and the amount of NS3 inhibitor and DD stabilizer was varied between 0 uM and 5 uM. CD69, IL-2 and IFN-gamma responses from CD4+ T cells were raised by the CD3z signaling domain alone which is induced by NS3 inhibitor. However, the CD28 signaling domain alone stabilized by TMP was not able to trigger any response. When both NS3 inhibitor and TMP were present, the stabilized CD28 signaling domain led to an even higher CD69 level, and IL-2 and IFN-gamma secretion. The killing ability of NS3-DD CAR CD8+ T cells was also induced by the presence of both drugs, and was shown to be tunable by varying drug concentration (see e.g., FIGS. 6B and 6C). Such combinatorial control over CAR activity provides both safety controls and signal balancing for improved tumor specificity.

Immunogenicity

Figure 7:
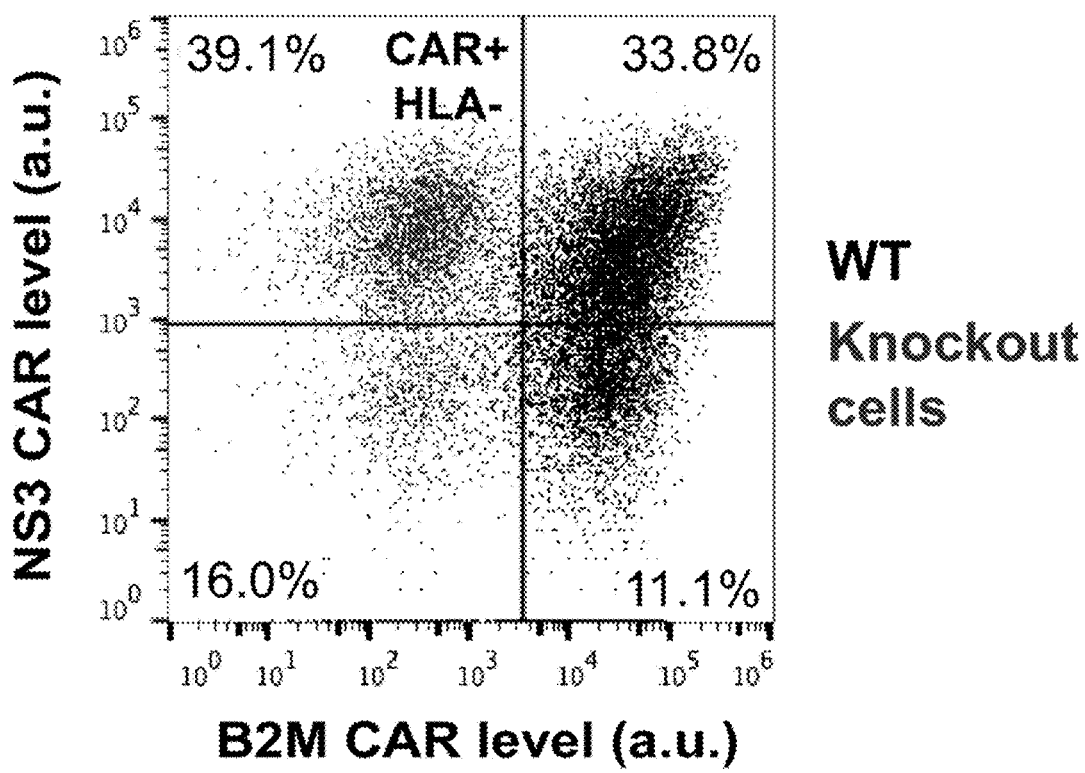
FIG. 7 is a flow cytometry dot plot showing the expression of the NS3 CAR and B2M in WT CD4+ T cells or B2M knockout CD4+ T cells.

The NS3 and DD domains are of non-human origin, and thus they can be digested and presented on the Human Leukocyte Antigen (HLA) of the engineered T cells to elicit an immune response. This could result in the clearance of therapeutic cells by the patient's endogenous cytotoxic T cells, thus diminishing their persistence in the body. One approach to reducing immunogenicity is to knock out HLA Class I that recruits CD8+ T cells. The β2M (and thus HLA-I) gene can be knocked out in NS3 CAR-expressing CD4+ T cells, suggesting the ability of these engineered cells to evade an immunogenic response (see e.g., FIG. 7).

Example 2

NS3 OFF CARs and Reader CARs

Figure 8A:
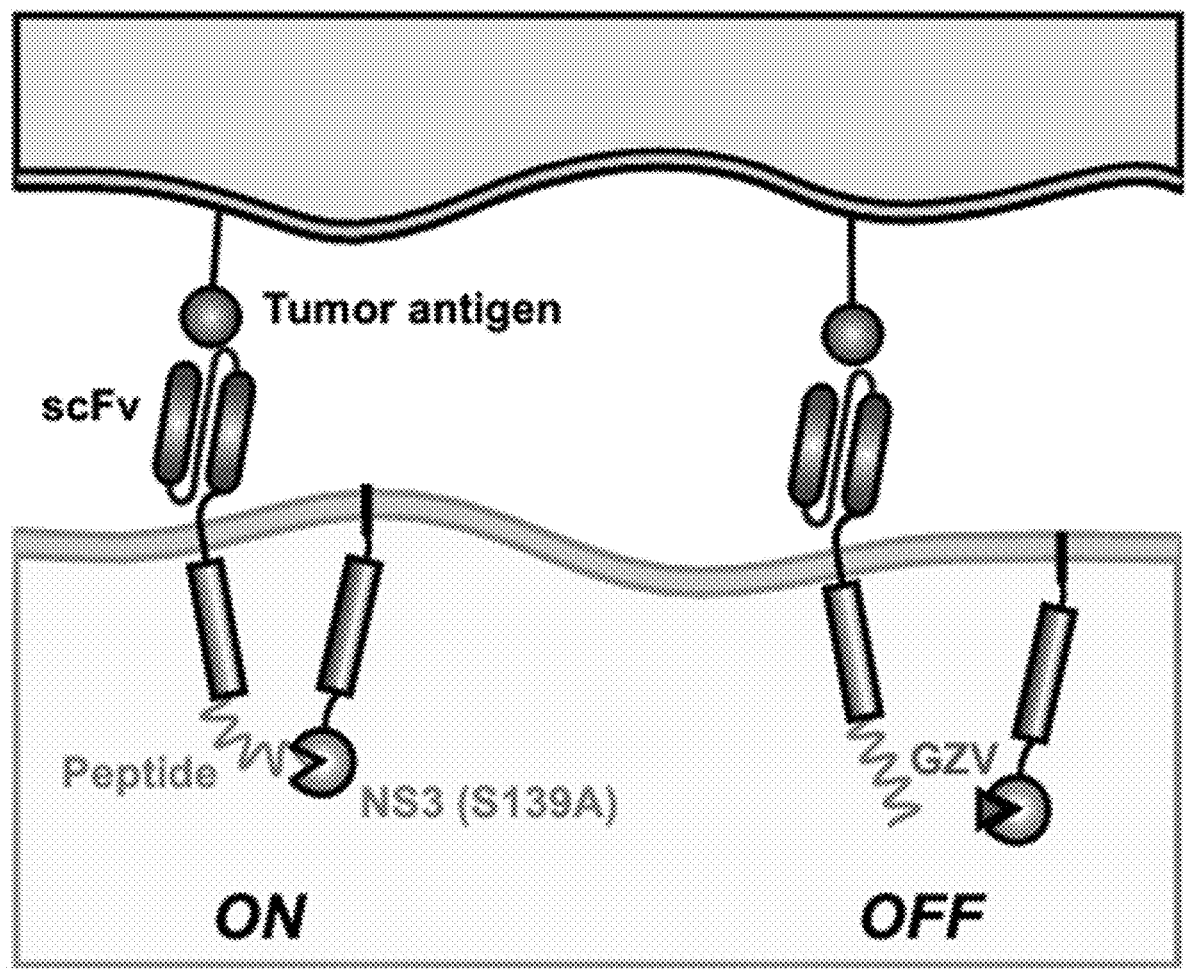
FIG. 8A-8D is a series of schematics and graphs showing testing of variations of the NS3 OFF CAR in Jurkat T cells.
Figure 8B:
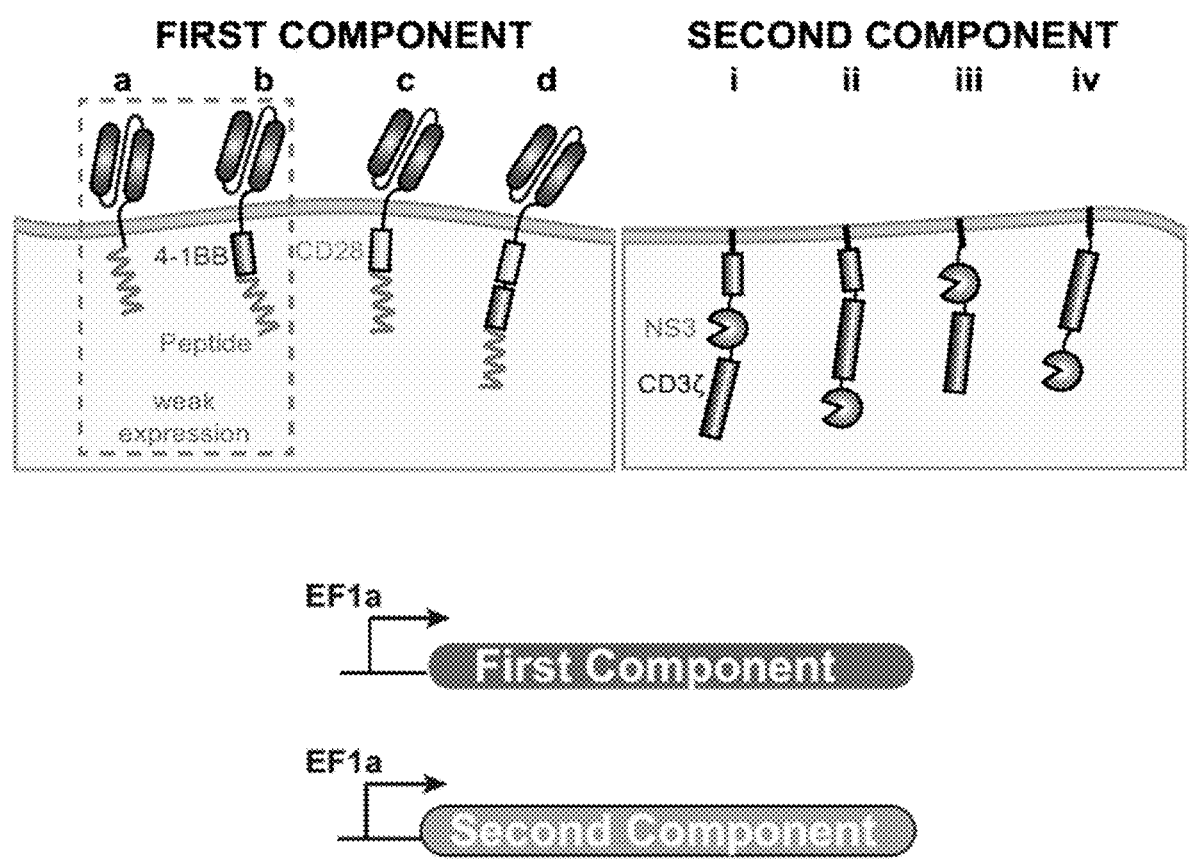

NS3 CAR OFF switches, comprising first and second components, were constructed as described herein. The first component comprises a peptide, which is specific for the NS3 of the second component, thus bringing the two components together. The NS3 used in the first component of the OFF switch is a catalytically-dead version of NS3, so it does not cleave the peptide. Accordingly, the first and second components do not comprise any protease cleavage sites. When added, the protease inhibitor competes with the peptide for binding to the inactive NS3, thus displacing the peptide, and the two components are no longer brought together (see e.g., FIG. 8A-8B).

Figure 8C:
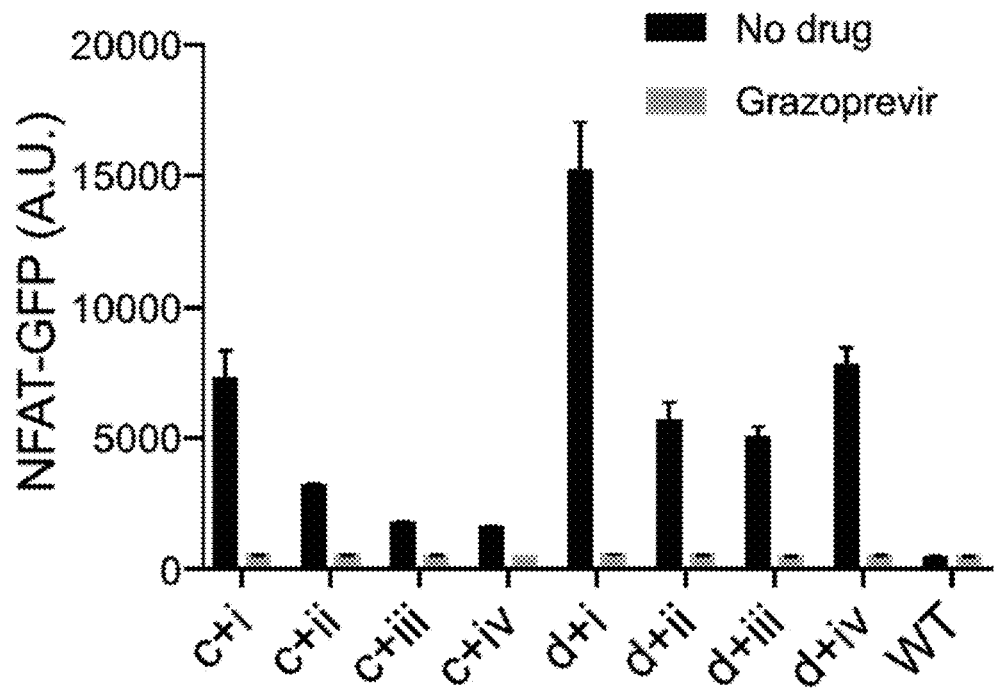
Figure 8D:
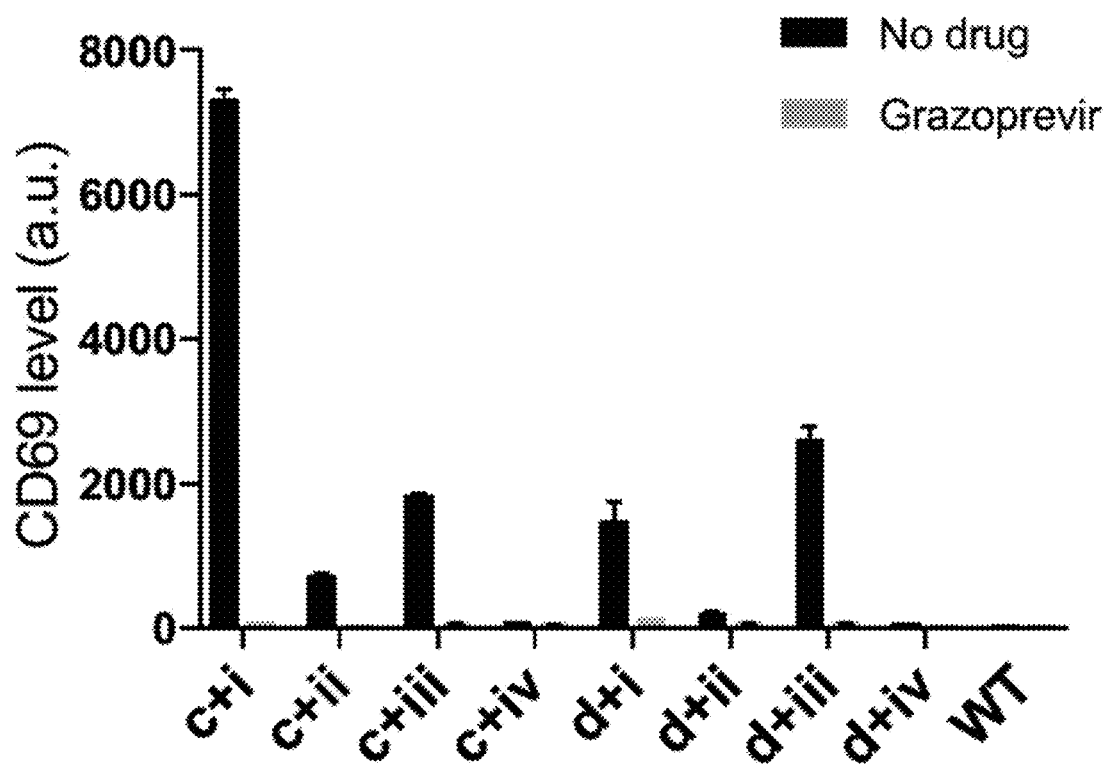
Figure 9C:
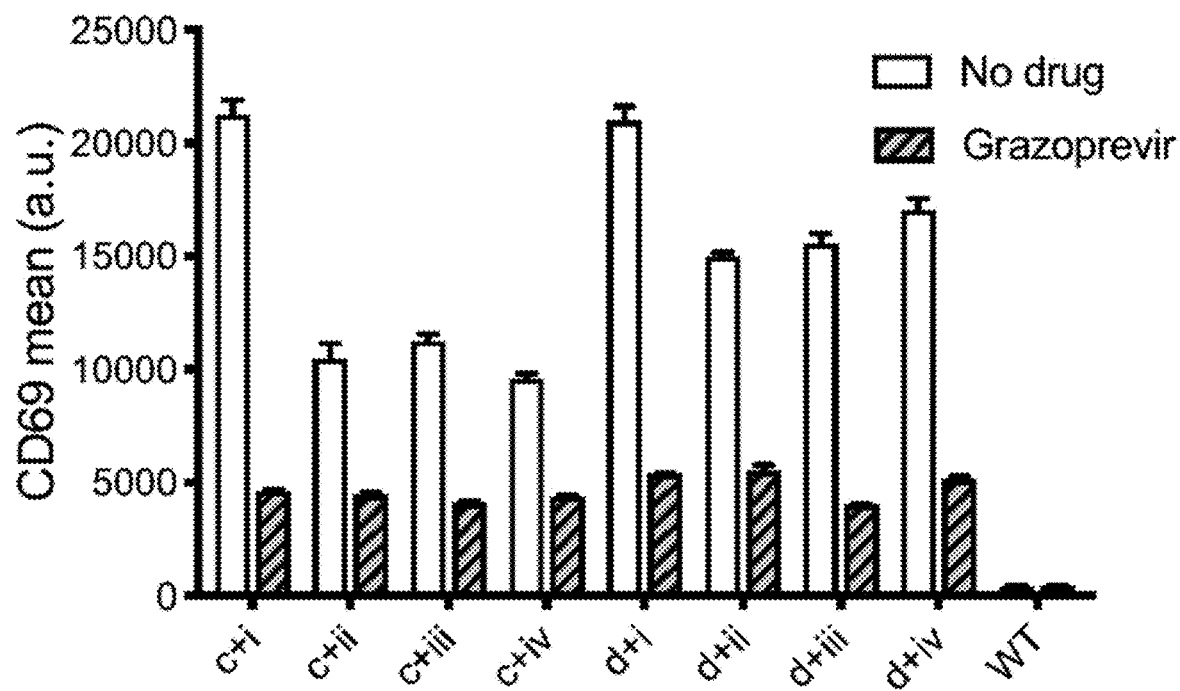
Figure 10A:
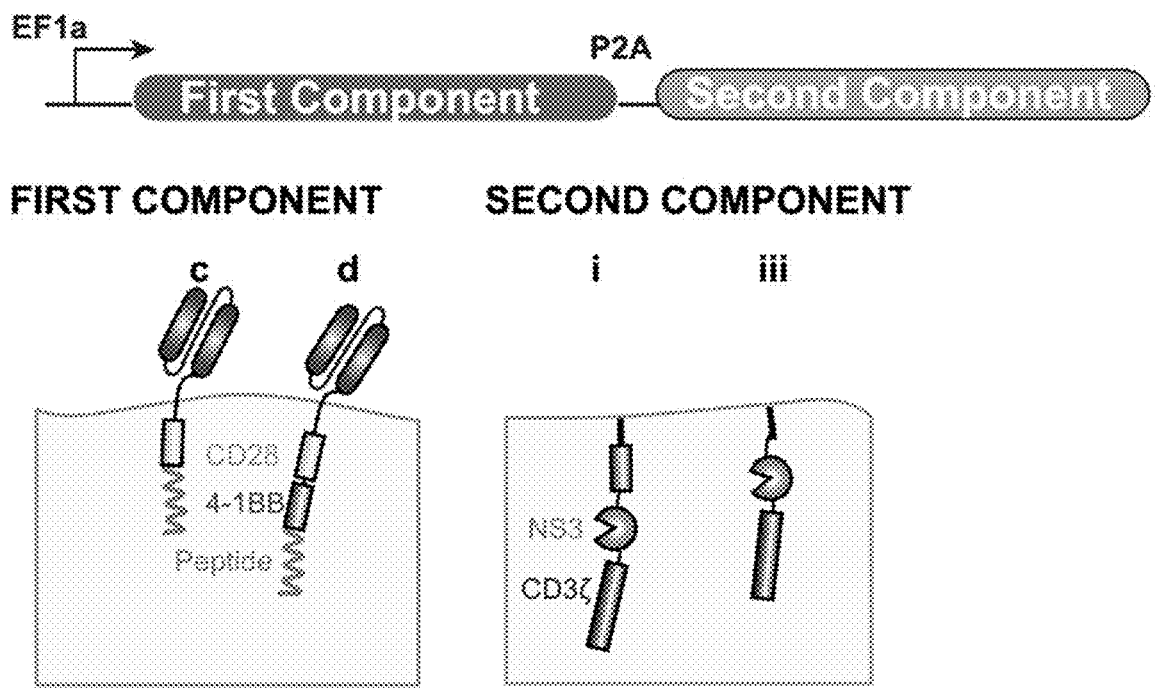
FIG. 10A-10D is a series of schematics and graphs showing testing of NS3 OFF switch CAR in primary T cells (PBMC) with components introduced in a single vector.
Figure 10B:
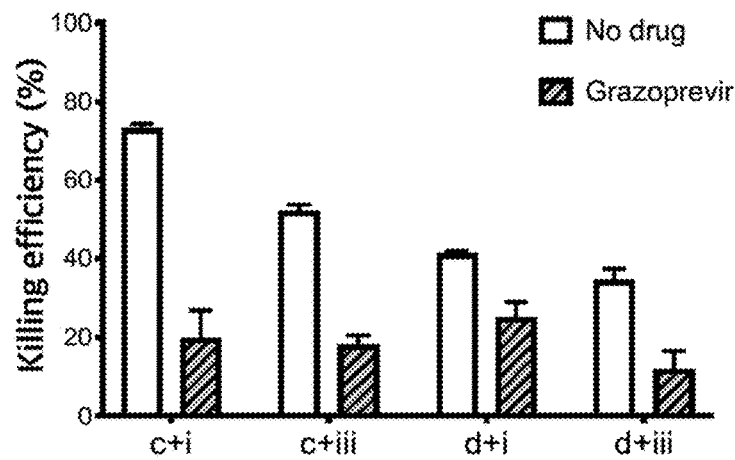
Figure 10C:
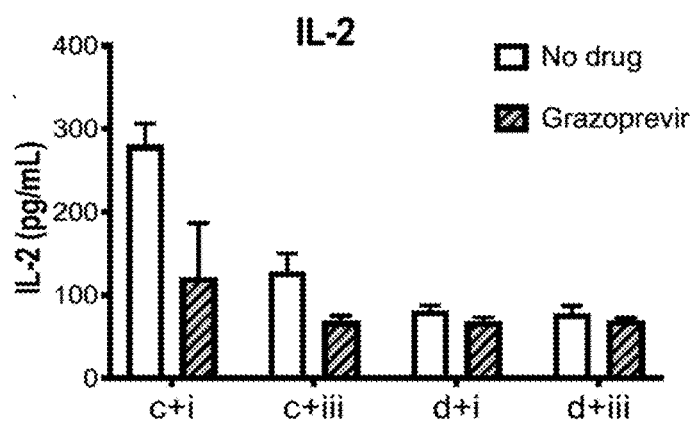
Figure 10D:
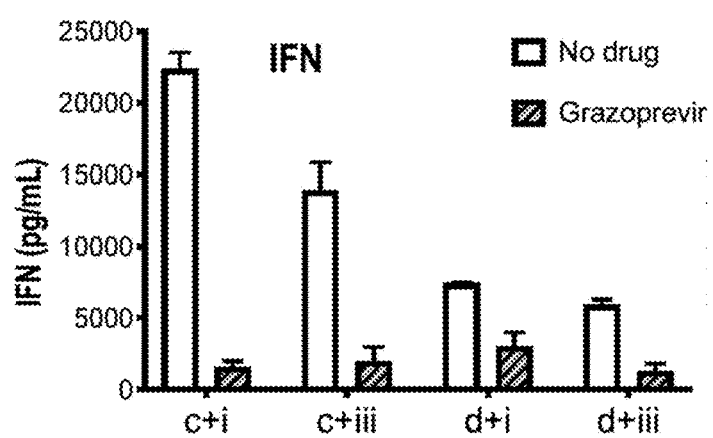

Two different versions of the first component (c and d) and four different versions of the second component of the OFF-switch (i, ii, iii, and iv) were tested in Jurkat T cells. Compared to WT cells, all permutations of the two-component OFF-switch resulted in detectable NFAT-GFP levels, which was diminished to baseline in the presence of grazoprevir (see e.g., FIG. 8C). Increased CD69 levels compared to wild type were also observed using various combinations of the first and second components in Jurkat cells, which was once again diminished to baseline in the presence of grazoprevir (see e.g., FIG. 8D). The OFF-switch CARs can also function when expressed in a single vector (see e.g., FIG. 9A-9C, FIG. 10A-10D).

Figure 12B:
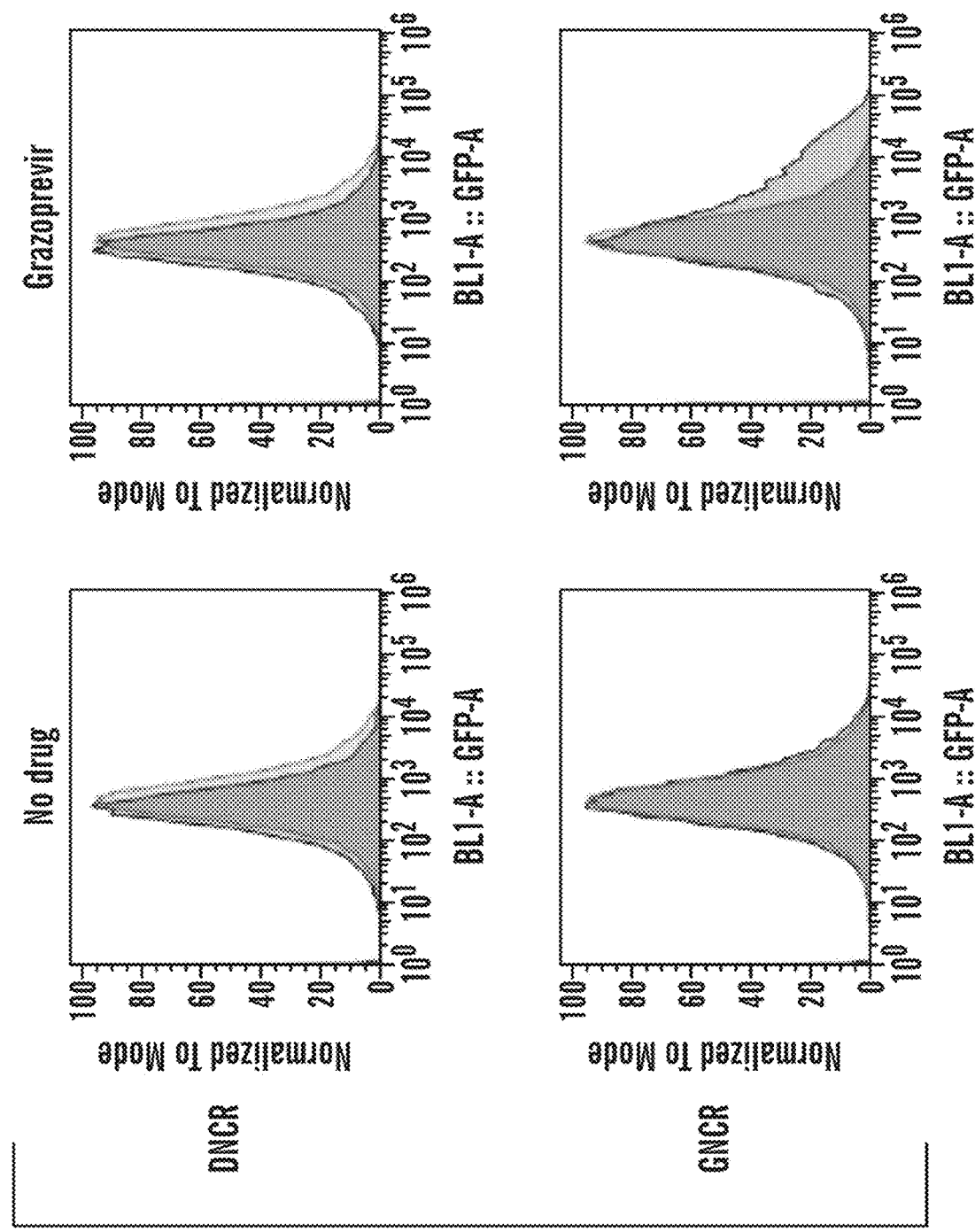
Figure 12C:
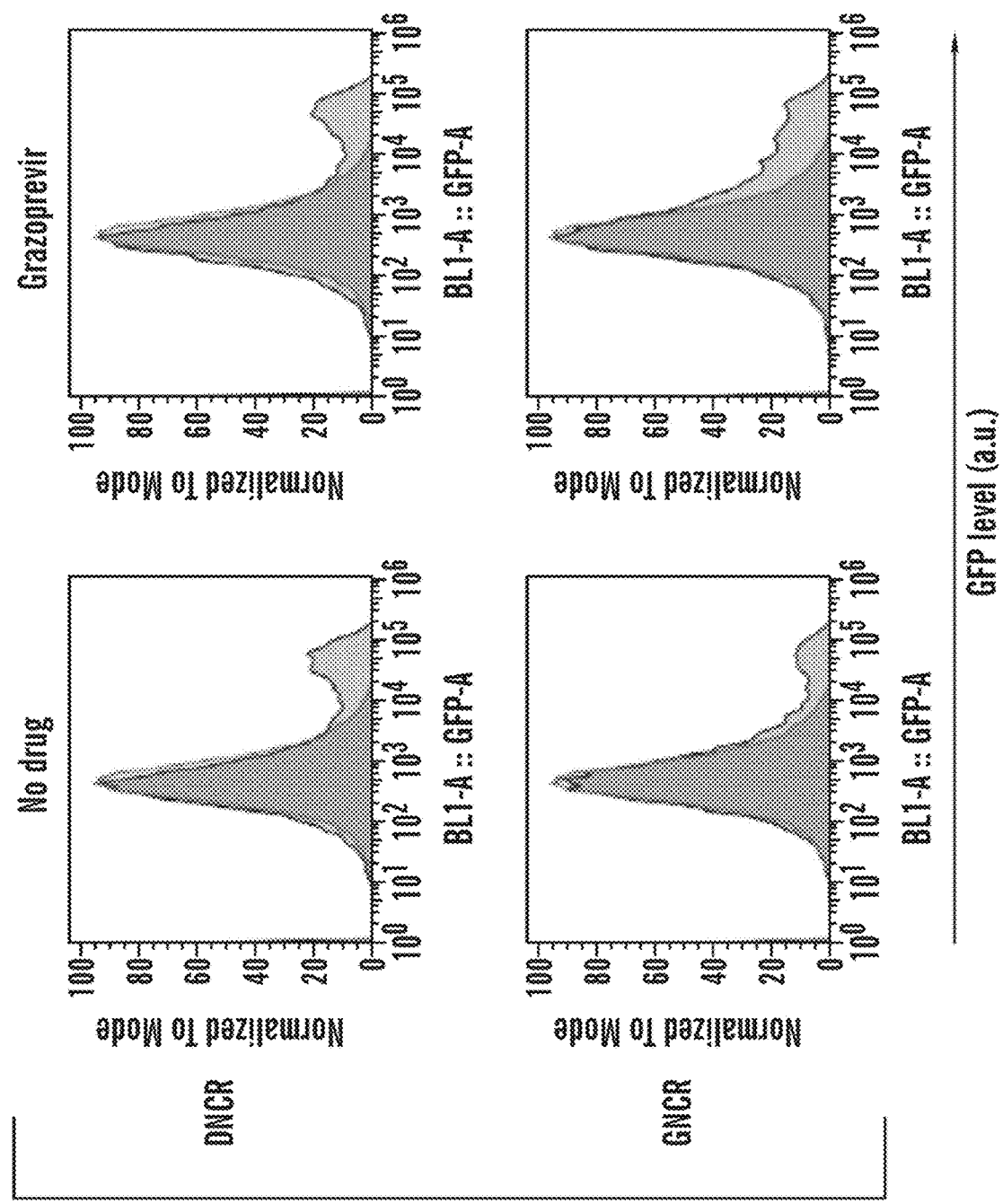

NS3 reader CAR polypeptides were also constructed and tested. Such CAR polypeptides comprise first component comprising a danoprevir/NS3 complex reader (DNCR) or a grazoprevir/NS3 reader complex (GNCR) and a second component comprising NS3 polypeptide and a CD3zeta signaling domain (see e.g., FIG. 12A). The second component is recruited to the reader domain of the first component only in the presence of its cognate protease inhibitor (e.g., danoprevir, grazoprevir, etc.) NS3 reader-C28-CAR polypeptides and a membrane-bound NS3 polypeptide were tested in Jurkat T cells. GFP levels (indicative of CAR activation) were highest when a DNCR reader was in the presence of danoprevir (DNV) or when a GNCR reader was in the presence of grazoprevir (GZV). Similarly, when testing NS3 readers comprising both CD28 and 4-1BB domains, GFP levels were once again highest with DNCR/DNV and GNCR/GZV (see e.g., FIG. 12B, FIG. 12C). The two components of the reader CAR can be expressed from the same vector (see e.g., FIG. 11A-11C).

SEQUENCE LISTING (270 sequences)

SEQ ID NO: 1 - DNA, 2571 bp, Artificial Sequence
  synthetic polynucleotide
atggccttaccagtgaccgccttgctcctgccgctggccttgctgctccacgccgccaggccgaaatacctattgcctacggcagccgctggattgttattactcgcggcccagccggccatggcccaggtgcagctggtgcagtctggggcagaggtgaaaaagcccggggagtctctgaagatctcctgtaagggttctggatacagctttaccagctactggatcgcctgggtgcgccagatgcccgggaaaggcctggagtacatggggctcatctatcctggtgactctgacaccaaatacagcccgtccttccaaggccaggtcaccatctcagtcgacaagtccgtcagcactgcctacttgcaatggagcagtctgaagccctcggacagcgccgtgtatttttgtgcgagacatgacgtgggatattgcaccgaccggacttgcgcaaagtggcctgaatacttccagcattggggccagggcaccctggtcaccgtctcctcaggtggaggcggttcaggcggaggtggctctggcggtggcggatcgcagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatctatgatcacaccaatcggcccgcaggggtccctgaccgattctctggctccaagtctggcacctcagcctccctggccatcagtgggttccggtccgaggatgaggctgattattactgtgcctcctgggactacaccctctcgggctgggtgttcggcggagggaccaagctgaccgtcctaggtgggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtggaggacgtggtgtgctgccactcaatctacggcaagaagaagggtgatatcgacacctaccgatacataggctcttccgggacaggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgatagggaggttctctaccaggagttcgatgagatggaagagtgctctcagcactatccctacgatgtgcccgattacgctaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 2 - DNA, 2571 bp, Artificial Sequence
  synthetic polynucleotide
atggccttaccagtgaccgccttgctcctgccgctggccttgctgctccacgccgccaggccgaaatacctattgcctacggcagccgctggattgttattactcgcggcccagccggccatggcccaggtgcagctggtgcagtctggggcagaggtgaaaaagcccggggagtctctgaagatctcctgtaagggttctggatacagctttaccagctactggatcgcctgggtgcgccagatgcccgggaaaggcctggagtacatggggctcatctatcctggtgactctgacaccaaatacagcccgtccttccaaggccaggtcaccatctcagtcgacaagtccgtcagcactgcctacttgcaatggagcagtctgaagccctcggacagcgccgtgtatttttgtgcgagacatgacgtgggatattgcaccgaccggacttgcgcaaagtggcctgaatacttccagcattggggccagggcaccctggtcaccgtctcctcaggtggaggcggttcaggcggaggtggctctggcggtggcggatcgcagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatctatgatcacaccaatcggcccgcaggggtccctgaccgattctctggctccaagtctggcacctcagcctccctggccatcagtgggttccggtccgaggatgaggctgattattactgtgcctcctgggactacaccctctcgggctgggtgttcggcggagggaccaagctgaccgtcctaggtgggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccgaggacgtggtgtgctgccactcaatctacggcaagaagaagggtgatatcgacacctaccgatacataggctcttccgggacaggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgatagggaggttctctaccaggagttcgatgagatggaagagtgctctcagcactatccctacgatgtgcccgattacgctaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 3 - DNA, 2571 bp, Artificial Sequence
  synthetic polynucleotide
atggccttaccagtgaccgccttgctcctgccgctggccttgctgctccacgccgccaggccgaaatacctattgcctacggcagccgctggattgttattactcgcggcccagccggccatggcccaggtgcagctggtgcagtctggggcagaggtgaaaaagcccggggagtctctgaagatctcctgtaagggttctggatacagctttaccagctactggatcgcctgggtgcgccagatgcccgggaaaggcctggagtacatggggctcatctatcctggtgactctgacaccaaatacagcccgtccttccaaggccaggtcaccatctcagtcgacaagtccgtcagcactgcctacttgcaatggagcagtctgaagccctcggacagcgccgtgtatttttgtgcgagacatgacgtgggatattgcaccgaccggacttgcgcaaagtggcctgaatacttccagcattggggccagggcaccctggtcaccgtctcctcaggtggaggcggttcaggcggaggtggctctggcggtggcggatcgcagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatctatgatcacaccaatcggcccgcaggggtccctgaccgattctctggctccaagtctggcacctcagcctccctggccatcagtgggttccggtccgaggatgaggctgattattactgtgcctcctgggactacaccctctcgggctgggtgttcggcggagggaccaagctgaccgtcctaggtgggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactggaggacgtggtgtgctgccactcaatctacggcaagaagaagggtgatatcgacacctaccgatacataggctcttccgggacaggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgatagggaggttctctaccaggagttcgatgagatggaagagtgctctcagcactatccctacgatgtgcccgattacgctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 4 - DNA, 1749 bp, Artificial Sequence
  synthetic polynucleotide
atggccttaccagtgaccgccttgctcctgccgctggccttgctgctccacgccgccaggccgaaatacctattgcctacggcagccgctggattgttattactcgcggcccagccggccatggcccaggtgcagctggtgcagtctggggcagaggtgaaaaagcccggggagtctctgaagatctcctgtaagggttctggatacagctttaccagctactggatcgcctgggtgcgccagatgcccgggaaaggcctggagtacatggggctcatctatcctggtgactctgacaccaaatacagcccgtccttccaaggccaggtcaccatctcagtcgacaagtccgtcagcactgcctacttgcaatggagcagtctgaagccctcggacagcgccgtgtatttttgtgcgagacatgacgtgggatattgcaccgaccggacttgcgcaaagtggcctgaatacttccagcattggggccagggcaccctggtcaccgtctcctcaggtggaggcggttcaggcggaggtggctctggcggtggcggatcgcagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatctatgatcacaccaatcggcccgcaggggtccctgaccgattctctggctccaagtctggcacctcagcctccctggccatcagtgggttccggtccgaggatgaggctgattattactgtgcctcctgggactacaccctctcgggctgggtgttcggcggagggaccaagctgaccgtcctaggtgggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 5 - DNA, 2322 bp, Artificial Sequence
  synthetic polynucleotide
atggccttaccagtgaccgccttgctcctgccgctggccttgctgctccacgccgccaggccgaaatacctattgcctacggcagccgctggattgttattactcgcggcccagccggccatggcccaggtgcagctggtgcagtctggggcagaggtgaaaaagcccggggagtctctgaagatctcctgtaagggttctggatacagctttaccagctactggatcgcctgggtgcgccagatgcccgggaaaggcctggagtacatggggctcatctatcctggtgactctgacaccaaatacagcccgtccttccaaggccaggtcaccatctcagtcgacaagtccgtcagcactgcctacttgcaatggagcagtctgaagccctcggacagcgccgtgtatttttgtgcgagacatgacgtgggatattgcaccgaccggacttgcgcaaagtggcctgaatacttccagcattggggccagggcaccctggtcaccgtctcctcaggtggaggcggttcaggcggaggtggctctggcggtggcggatcgcagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatctatgatcacaccaatcggcccgcaggggtccctgaccgattctctggctccaagtctggcacctcagcctccctggccatcagtgggttccggtccgaggatgaggctgattattactgtgcctcctgggactacaccctctcgggctgggtgttcggcggagggaccaagctgaccgtcctaggtgggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtggaggacgtggtgtgctgccactcaatctacggcaagaagaagggtgatatcgacacctaccgatacataggctcttccgggacaggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgatagggaggttctctaccaggagttcgatgagatggaagagtgctctcagcactatccctacgatgtgcccgattacgctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 6 - DNA, 1635 bp, Artificial Sequence
  synthetic polynucleotide
atggccctgcctgtgacagctctgctgctgcctctggccctgctgctgcatgctgctagacctcaggtgcagctgcaggaaagcggccctggcctcgtgaagcctagcgagacactgagcctgacctgcaccgtgtccggctacagcatcaccagcaactactggggctggatcagacagccccctggcaagggcctggaatggatgggctacatcacctacagcggcagcaccagctacaaccccagcctgaagtcccggatcaccatcagccgggacaccagcaagaaccagttctccctgaagctgagcagcgtgacagccgccgataccgccgtgtactactgcgccatcaccaccttctactattggggccagggcaccctcgtgaccgtgtctagcggaggcggaggatctggcggcggaggaagtggcggagggggctctgatatccagatgacccagagccccagcagcctgtctgccagcgtgggcgacagagtgaccatcacctgtagagccagccaggacatcggcaactacctgcggtggttccagcagaagccaggcaaggcccccaagctgctgatctccggcgccacaaatctggccgctggcgtgccaagcagattcagcggctctggcagcggctccgacttcaccctgaccatctctagcctgcagcccgaggacttcgccacctactactgcctgcagagcaaagagagcccctggaccttcggacagggcaccaaggtggaaatcaagcggacagaacaaaaactcatctcagaagaagatctgaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccggcatcagtctgattgcggcgttagcggtagattacgttatcggcatggaaaacgccatgccgtggaacctgcctgccgatctcgcctggtttaaacgcaacaccttaaataaacccgtgattatgggccgccatacctgggaatcaatcggtcgtccgttgccaggacgcaaaaatattatcctcagcagtcaaccgagtacggacgatcgcgtaacgtgggtgaagtcggtggatgaagccatcgcggcgtgtggtgacgtaccagaaatcatggtgattggcggcggtcgcgttattgaacagttcttgccaaaagcgcaaaaactgtatctgacgcatatcgacgcagaagtggaaggcgacacccatttcccggattacgagccggatgactgggaatcggtattcagcgagttccacgatgctgatgcgcagaactctcacagctattgctttgagattctggagcggcgataa

SEQ ID NO: 7 - DNA, 63 bp, Artificial Sequence
  synthetic polynucleotide
atggccttaccagtgaccgccttgctcctgccgctggccttgctgctccacgccgccaggccg

SEQ ID NO: 8 - DNA, 828 bp, Artificial Sequence
  synthetic polynucleotide
aaatacctattgcctacggcagccgctggattgttattactcgcggcccagccggccatggcccaggtgcagctggtgcagtctggggcagaggtgaaaaagcccggggagtctctgaagatctcctgtaagggttctggatacagctttaccagctactggatcgcctgggtgcgccagatgcccgggaaaggcctggagtacatggggctcatctatcctggtgactctgacaccaaatacagcccgtccttccaaggccaggtcaccatctcagtcgacaagtccgtcagcactgcctacttgcaatggagcagtctgaagccctcggacagcgccgtgtatttttgtgcgagacatgacgtgggatattgcaccgaccggacttgcgcaaagtggcctgaatacttccagcattggggccagggcaccctggtcaccgtctcctcaggtggaggcggttcaggcggaggtggctctggcggtggcggatcgcagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatctatgatcacaccaatcggcccgcaggggtccctgaccgattctctggctccaagtctggcacctcagcctccctggccatcagtgggttccggtccgaggatgaggctgattattactgtgcctcctgggactacaccctctcgggctgggtgttcggcggagggaccaagctgaccgtcctaggt

SEQ ID NO: 9 - DNA, 42 bp, Artificial Sequence
  synthetic polynucleotide
gggaagcctatcccgaaccctctgttgggtctcgatagtacc

SEQ ID NO: 10 - DNA, 135 bp, Artificial Sequence
  synthetic polynucleotide
accacgacgccagcgccgcgaccaccaacaccggcgcccaccatcgcgttgcagcccctgtccctgcgcccagaggcgtgccggccagcggcggggggcgcagtgcacacgagggggctggacttcgcctgtgat

SEQ ID NO: 11 - DNA, 81 bp, Artificial Sequence
  synthetic polynucleotide
ttttgggtgctggtggtggttggtggagtcctggcttgctatagcttgctagtaacagtggcctttattattttctgggtg

SEQ ID NO: 12 - DNA, 30 bp, Artificial Sequence
  synthetic polynucleotide
gaggacgtggtgtgctgccactcaatctac

SEQ ID NO: 13 - DNA, 24 bp, Artificial Sequence
  synthetic polynucleotide
cactcaatctacggcaagaagaag

SEQ ID NO: 14 - DNA, 18 bp, Artificial Sequence
  synthetic polynucleotide
gacacctaccgatacata

SEQ ID NO: 15 - DNA, 39 bp, Artificial Sequence
  synthetic polynucleotide
ggctgcgtggtcatagtgggcaggatcgtcttgtccgga

SEQ ID NO: 16 - DNA, 567 bp, Artificial Sequence
  synthetic polynucleotide
gcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctct

SEQ ID NO: 17 - DNA, 42 bp, Artificial Sequence
  synthetic polynucleotide
ctctaccaggagttcgatgagatggaagagtgctctcagcac

SEQ ID NO: 18 - DNA, 27 bp, Artificial Sequence
  synthetic polynucleotide
tatccctacgatgtgcccgattacgct

SEQ ID NO: 19 - DNA, 123 bp, Artificial Sequence
  synthetic polynucleotide
aggagtaagaggagcaggctcctgcacagtgactacatgaacatgactccccgccgccccgggcccacccgcaagcattaccagccctatgccccaccacgcgacttcgcagcctatcgctcc

SEQ ID NO: 20 - DNA, 126 bp, Artificial Sequence
  synthetic polynucleotide
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 21 - DNA, 336 bp, Artificial Sequence
  synthetic polynucleotide
agagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 22 - DNA, 339 bp, Artificial Sequence
  synthetic polynucleotide
caggtgcagctgcaggaaagcggccctggcctcgtgaagcctagcgagacactgagcctgacctgcaccgtgtccggctacagcatcaccagcaactactggggctggatcagacagccccctggcaagggcctggaatggatgggctacatcacctacagcggcagcaccagctacaaccccagcctgaagtcccggatcaccatcagccgggacaccagcaagaaccagttctccctgaagctgagcagcgtgacagccgccgataccgccgtgtactactgcgccatcaccaccttctactattggggccagggcaccctcgtgaccgtgtctagc

SEQ ID NO: 23 - DNA, 45 bp, Artificial Sequence
  synthetic polynucleotide
ggaggcggaggatctggcggcggaggaagtggcggagggggctct

SEQ ID NO: 24 - DNA, 327 bp, Artificial Sequence
  synthetic polynucleotide
gatatccagatgacccagagccccagcagcctgtctgccagcgtgggcgacagagtgaccatcacctgtagagccagccaggacatcggcaactacctgcggtggttccagcagaagccaggcaaggcccccaagctgctgatctccggcgccacaaatctggccgctggcgtgccaagcagattcagcggctctggcagcggctccgacttcaccctgaccatctctagcctgcagcccgaggacttcgccacctactactgcctgcagagcaaagagagcccctggaccttcggacagggcaccaaggtggaaatcaagcggaca

SEQ ID NO: 25 - DNA, 30 bp, Artificial Sequence
  synthetic polynucleotide
gaacaaaaactcatctcagaagaagatctg

SEQ ID NO: 26 - DNA, 474 bp, Artificial Sequence
  synthetic polynucleotide
atcagtctgattgcggcgttagcggtagattacgttatcggcatggaaaacgccatgccgtggaacctgcctgccgatctcgcctggtttaaacgcaacaccttaaataaacccgtgattatgggccgccatacctgggaatcaatcggtcgtccgttgccaggacgcaaaaatattatcctcagcagtcaaccgagtacggacgatcgcgtaacgtgggtgaagtcggtggatgaagccatcgcggcgtgtggtgacgtaccagaaatcatggtgattggcggcggtcgcgttattgaacagttcttgccaaaagcgcaaaaactgtatctgacgcatatcgacgcagaagtggaaggcgacacccatttcccggattacgagccggatgactgggaatcggtattcagcgagttccacgatgctgatgcgcagaactctcacagctattgctttgagattctggagcggcga

SEQ ID NO: 27 - DNA, 19 bp, Artificial Sequence
  synthetic oligonucleotide
atggccttaccagtgaccg

SEQ ID NO: 28 - DNA, 16 bp, Artificial Sequence
  synthetic oligonucleotide
ttagcgagggggcagg

SEQ ID NO: 29 - DNA, 55 bp, Artificial Sequence
  synthetic oligonucleotide
ccgctaacgccgcaatcagactgatgccggagcgataggctgcgaagtcgcgtgg

SEQ ID NO: 30 - DNA, 25 bp, Artificial Sequence
  synthetic oligonucleotide
atcagtctgattgcggcgttagcgg

SEQ ID NO: 31 - DNA, 49 bp, Artificial Sequence
  synthetic oligonucleotide
tgcgctcctgctgaacttcactctagcgtaatcgggcacatcgtaggga

SEQ ID NO: 32 - DNA, 25 bp, Artificial Sequence
  synthetic oligonucleotide
agagtgaagttcagcaggagcgcag

SEQ ID NO: 33 - DNA, 60 bp, Artificial Sequence
  synthetic oligonucleotide
cctgcaggtcgactctagagtcgcggccgcactagtttagcgagggggcagggcctgcat

SEQ ID NO: 34 - protein, 855 aa, Artificial Sequence
  synthetic polypeptide
ALPVTALLLPLALLLHAARPKYLLPTAAAGLLLLAAQPAMAQVQLVQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVGYCTDRTCAKWPEYFQHWGQGTLVTVSSGGGGSGGGGSGGGGSQSVLTQPPSVSAAPGQKVTISCSGSSSNIGNNYVSWYQQLPGTAPKLLIYDHTNRPAGVPDRFSGSKSGTSASLAISGFRSEDEADYYCASWDYTLSGWVFGGGTKLTVLGGKPIPNPLLGLDSTNGAATTTPAPRPPTPAPTIALQPLSLRPEACRPAAGGAVHTRGLDFACDFWVLVVVGGVLACYSLLVTVAFIIFWVEDVVCCHSIYGKKKGDIDTYRYIGSSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDREVLYQEFDEMEECSQHYPYDVPDYARSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 35 - protein, 855 aa, Artificial Sequence
  synthetic polypeptide
ALPVTALLLPLALLLHAARPKYLLPTAAAGLLLLAAQPAMAQVQLVQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVGYCTDRTCAKWPEYFQHWGQGTLVTVSSGGGGSGGGGSGGGGSQSVLTQPPSVSAAPGQKVTISCSGSSSNIGNNYVSWYQQLPGTAPKLLIYDHTNRPAGVPDRFSGSKSGTSASLAISGFRSEDEADYYCASWDYTLSGWVFGGGTKLTVLGGKPIPNPLLGLDSTNGAATTTPAPRPPTPAPTIALQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSEDVVCCHSIYGKKKGDIDTYRYIGSSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDREVLYQEFDEMEECSQHYPYDVPDYAKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 36 - protein, 855 aa, Artificial Sequence
  synthetic polypeptide
ALPVTALLLPLALLLHAARPKYLLPTAAAGLLLLAAQPAMAQVQLVQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVGYCTDRTCAKWPEYFQHWGQGTLVTVSSGGGGSGGGGSGGGGSQSVLTQPPSVSAAPGQKVTISCSGSSSNIGNNYVSWYQQLPGTAPKLLIYDHTNRPAGVPDRFSGSKSGTSASLAISGFRSEDEADYYCASWDYTLSGWVFGGGTKLTVLGGKPIPNPLLGLDSTNGAATTTPAPRPPTPAPTIALQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELEDVVCCHSIYGKKKGDIDTYRYIGSSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDREVLYQEFDEMEECSQHYPYDVPDYARVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 37 - protein, 581 aa, Artificial Sequence
  synthetic polypeptide
ALPVTALLLPLALLLHAARPKYLLPTAAAGLLLLAAQPAMAQVQLVQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVGYCTDRTCAKWPEYFQHWGQGTLVTVSSGGGGSGGGGSGGGGSQSVLTQPPSVSAAPGQKVTISCSGSSSNIGNNYVSWYQQLPGTAPKLLIYDHTNRPAGVPDRFSGSKSGTSASLAISGFRSEDEADYYCASWDYTLSGWVFGGGTKLTVLGGKPIPNPLLGLDSTNGAATTTPAPRPPTPAPTIALQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 38 - protein, 772 aa, Artificial Sequence
  synthetic polypeptide
ALPVTALLLPLALLLHAARPKYLLPTAAAGLLLLAAQPAMAQVQLVQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVGYCTDRTCAKWPEYFQHWGQGTLVTVSSGGGGSGGGGSGGGGSQSVLTQPPSVSAAPGQKVTISCSGSSSNIGNNYVSWYQQLPGTAPKLLIYDHTNRPAGVPDRFSGSKSGTSASLAISGFRSEDEADYYCASWDYTLSGWVFGGGTKLTVLGGKPIPNPLLGLDSTNGAATTTPAPRPPTPAPTIALQPLSLRPEACRPAAGGAVHTRGLDFACDFWVLVVVGGVLACYSLLVTVAFIIFWVEDVVCCHSIYGKKKGDIDTYRYIGSSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDREVLYQEFDEMEECSQHYPYDVPDYARVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 39 - protein, 543 aa, Artificial Sequence
  synthetic polypeptide
ALPVTALLLPLALLLHAARPQVQLQESGPGLVKPSETLSLTCTVSGYSITSNYWGWIRQPPGKGLEWMGYITYSGSTSYNPSLKSRITISRDTSKNQFSLKLSSVTAADTAVYYCAITTFYYWGQGTLVTVSSGGGGSGGGGSGGGGSDIQMTQSPSSLSASVGDRVTITCRASQDIGNYLRWFQQKPGKAPKLLISGATNLAAGVPSRFSGSGSGSDFTLTISSLQPEDFATYYCLQSKESPWTFGQGTKVEIKRTEQKLISEEDLNGAATTTPAPRPPTPAPTIALQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSGISLIAALAVDYVIGMENAMPWNLPADLAWFKRNTLNKPVIMGRHTWESIGRPLPGRKNIILSSQPSTDDRVTWVKSVDEAIAACGDVPEIMVIGGGRVIEQFLPKAQKLYLTHIDAEVEGDTHFPDYEPDDWESVFSEFHDADAQNSHSYCFEILERR

SEQ ID NO: 40 - protein, 21 aa, Artificial Sequence
  synthetic polypeptide
MALPVTALLLPLALLLHAARP

SEQ ID NO: 41 - protein, 276 aa, Artificial Sequence
  synthetic polypeptide
KYLLPTAAAGLLLLAAQPAMAQVQLVQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVGYCTDRTCAKWPEYFQHWGQGTLVTVSSGGGGSGGGGSGGGGSQSVLTQPPSVSAAPGQKVTISCSGSSSNIGNNYVSWYQQLPGTAPKLLIYDHTNRPAGVPDRFSGSKSGTSASLAISGFRSEDEADYYCASWDYTLSGWVFGGGTKLTVLG

SEQ ID NO: 42 - protein, 14 aa, Artificial Sequence
  synthetic polypeptide
GKPIPNPLLGLDST

SEQ ID NO: 43 - protein, 45 aa, Artificial Sequence
  synthetic polypeptide
TTTPAPRPPTPAPTIALQPLSLRPEACRPAAGGAVHTRGLDFACD

SEQ ID NO: 44 - protein, 27 aa, Artificial Sequence
  synthetic polypeptide
FWVLVVVGGVLACYSLLVTVAFIIFWV

SEQ ID NO: 45 - protein, 10 aa, Artificial Sequence
  synthetic polypeptide
EDVVCCHSIY

SEQ ID NO: 46 - protein, 8 aa, Artificial Sequence
  synthetic polypeptide
HSIYGKKK

SEQ ID NO: 47 - protein, 6 aa, Artificial Sequence
  synthetic polypeptide
DTYRYI

SEQ ID NO: 48 - protein, 13 aa, Artificial Sequence
  synthetic polypeptide
GCVVIVGRIVLSG

SEQ ID NO: 49 - protein, 189 aa, Artificial Sequence
  synthetic polypeptide
APITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSS

SEQ ID NO: 50 - protein, 14 aa, Artificial Sequence
  synthetic polypeptide
LYQEFDEMEECSQH

SEQ ID NO: 51 - protein, 9 aa, Artificial Sequence
  synthetic polypeptide
YPYDVPDYA

SEQ ID NO: 52 - protein, 41 aa, Artificial Sequence
  synthetic polypeptide
RSKRSRLLHSDYMNMTPRRPGPTRKHYQPYAPPRDFAAYRS

SEQ ID NO: 53 - protein, 42 aa, Artificial Sequence
  synthetic polypeptide
KRGRKKLLYIFKQPFMRPVQTTQEEDGCSCRFPEEEEGGCEL

SEQ ID NO: 54 - protein, 112 aa, Artificial Sequence
  synthetic polypeptide
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 55 - protein, 113 aa, Artificial Sequence
  synthetic polypeptide
QVQLQESGPGLVKPSETLSLTCTVSGYSITSNYWGWIRQPPGKGLEWMGYITYSGSTSYNPSLKSRITISRDTSKNQFSLKLSSVTAADTAVYYCAITTFYYWGQGTLVTVSS

SEQ ID NO: 56 - protein, 15 aa, Artificial Sequence
  synthetic polypeptide
GGGGSGGGGSGGGGS

SEQ ID NO: 57 - protein, 109 aa, Artificial Sequence
  synthetic polypeptide
DIQMTQSPSSLSASVGDRVTITCRASQDIGNYLRWFQQKPGKAPKLLISGATNLAAGVPSRFSGSGSGSDFTLTISSLQPEDFATYYCLQSKESPWTFGQGTKVEIKRT

SEQ ID NO: 58 - protein, 10 aa, Artificial Sequence
  synthetic polypeptide
EQKLISEEDL

SEQ ID NO: 59 - protein, 158 aa, Artificial Sequence
  synthetic polypeptide
ISLIAALAVDYVIGMENAMPWNLPADLAWFKRNTLNKPVIMGRHTWESIGRPLPGRKNIILSSQPSTDDRVTWVKSVDEAIAACGDVPEIMVIGGGRVIEQFLPKAQKLYLTHIDAEVEGDTHFPDYEPDDWESVFSEFHDADAQNSHSYCFEILERR

SEQ ID NO: 60 - DNA, 1329 bp, Artificial Sequence
  synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccgggggtaccgaattcagcgggtcaggcggatctggaagtggtggtggagaacttgatgaattggtatacttactagatgggccaggttatgaccctatacattgcgatgtagtgacaaggggcggcagccaccttttcaatttttaa

SEQ ID NO: 61 - DNA, 1455 bp, Artificial Sequence
  synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactggggggtaccgaattcagcgggtcaggcggatctggaagtggtggtggagaacttgatgaattggtatacttactagatgggccaggttatgaccctatacattgcgatgtagtgacaaggggcggcagccaccttttcaatttttaa

SEQ ID NO: 62 - DNA, 1968 bp, Artificial Sequence
  synthetic polynucleotide
atgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 63 - DNA, 1968 bp, Artificial Sequence
  synthetic polynucleotide
atgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 64 - DNA, 1842 bp, Artificial Sequence
  synthetic polynucleotide
atgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 65 - DNA, 1842 bp, Artificial Sequence
  synthetic polynucleotide
atgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 66 - DNA, 3945 bp, Artificial Sequence
  synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccggctcaggaagctcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcatggcagtggagagggcagaggaagtctgctaacatgcggtgacgtcgaggagaatcctggcccaatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 67 - DNA, 4071 bp, Artificial Sequence
  synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgggctcaggaagctcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcatggcagtggagagggcagaggaagtctgctaacatgcggtgacgtcgaggagaatcctggcccaatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 68 - DNA, 3957 bp, Artificial Sequence
  synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccggctcaggaagcgatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtccggcagtggagagggcagaggaagtctgctaacatgcggtgacgtcgaggagaatcctggcccaatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 69 - DNA, 4083 bp, Artificial Sequence
  synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgggctcaggaagcgatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtccggcagtggagagggcagaggaagtctgctaacatgcggtgacgtcgaggagaatcctggcccaatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 70 - DNA, 726 bp, Artificial Sequence
  synthetic polynucleotide
gacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctca

SEQ ID NO: 71 - DNA, 99 bp, Artificial Sequence
  synthetic polynucleotide
ggagaacttgatgaattggtatacttactagatgggccaggttatgaccctatacattgcgatgtagtgacaaggggcggcagccaccttttcaatttt

SEQ ID NO: 72 - DNA, 144 bp, Artificial Sequence
  synthetic polynucleotide
atgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcct

SEQ ID NO: 73 - DNA, 63 bp, Artificial Sequence
  synthetic polynucleotide
atatacatctgggctcctctggctggcacttgcggagtgcttctgctgagtctggttattacc

SEQ ID NO: 74 - DNA, 36 bp, Artificial Sequence
  synthetic polynucleotide
ggttctgttgttattgttggtagaattattttatct

SEQ ID NO: 75 - DNA, 537 bp, Artificial Sequence
  synthetic polynucleotide
atcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtct

SEQ ID NO: 76 - DNA, 711 bp, Artificial Sequence
  synthetic polynucleotide
atggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 77 - DNA, 687 bp, Artificial Sequence
  synthetic polynucleotide
tcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcat

SEQ ID NO: 78 - DNA, 63 bp, Artificial Sequence
  synthetic polynucleotide
ggcagtggagagggcagaggaagtctgctaacatgcggtgacgtcgaggagaatcctggccca

SEQ ID NO: 79 - DNA, 567 bp, Artificial Sequence
  synthetic polynucleotide
gcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctct

SEQ ID NO: 80 - DNA, 12 bp, Artificial Sequence
  synthetic polynucleotide
ggctcaggaagc

SEQ ID NO: 81 - DNA, 699 bp, Artificial Sequence
  synthetic polynucleotide
gatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcc

SEQ ID NO: 82 - DNA, 51 bp, Artificial Sequence
  synthetic oligonucleotide
cctgacccgctgaattcggtacccccggagcgataggctgcgaagtcgcgt

SEQ ID NO: 83 - DNA, 27 bp, Artificial Sequence
  synthetic oligonucleotide
gggggtaccgaattcagcgggtcaggc

SEQ ID NO: 84 - protein, 441 aa, Artificial Sequence
  synthetic polypeptide
ALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGKPIPNPLLGLDSTNGAATTTPAPRPPTPAPTIALQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSGGTEFSGSGGSGSGGGELDELVYLLDGPGYDPIHCDVVTRGGSHLFNF

SEQ ID NO: 85 - protein, 483 aa, Artificial Sequence
  synthetic polypeptide
ALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGKPIPNPLLGLDSTNGAATTTPAPRPPTPAPTIALQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELGGTEFSGSGGSGSGGGELDELVYLLDGPGYDPIHCDVVTRGGSHLFNF

SEQ ID NO: 86 - protein, 654 aa, Artificial Sequence
  synthetic polypeptide
IHLGHILFLLLLPVAAAQTTPGERSSLPAFYPGTSGSCSGCGSLSLPIYIWAPLAGTCGVLLLSLVITKRGRKKLLYIFKQPFMRPVQTTQEEDGCSCRFPEEEEGGCELGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 87 - protein, 654 aa, Artificial Sequence
  synthetic polypeptide
IHLGHILFLLLLPVAAAQTTPGERSSLPAFYPGTSGSCSGCGSLSLPIYIWAPLAGTCGVLLLSLVITKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSGMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 88 - protein, 612 aa, Artificial Sequence
  synthetic polypeptide
IHLGHILFLLLLPVAAAQTTPGERSSLPAFYPGTSGSCSGCGSLSLPIYIWAPLAGTCGVLLLSLVITGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 89 - protein, 612 aa, Artificial Sequence
  synthetic polypeptide
IHLGHILFLLLLPVAAAQTTPGERSSLPAFYPGTSGSCSGCGSLSLPIYIWAPLAGTCGVLLLSLVITRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSGMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 90 - protein, 1313 aa, Artificial Sequence
  synthetic polypeptide
ALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGKPIPNPLLGLDSTNGAATTTPAPRPPTPAPTIALQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSGSGSSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHGSGEGRGSLLTCGDVEENPGPMIHLGHILFLLLLPVAAAQTTPGERSSLPAFYPGTSGSCSGCGSLSLPIYIWAPLAGTCGVLLLSLVITKRGRKKLLYIFKQPFMRPVQTTQEEDGCSCRFPEEEEGGCELGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 91 - protein, 1355 aa, Artificial Sequence
  synthetic polypeptide
ALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGKPIPNPLLGLDSTNGAATTTPAPRPPTPAPTIALQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELGSGSSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHGSGEGRGSLLTCGDVEENPGPMIHLGHILFLLLLPVAAAQTTPGERSSLPAFYPGTSGSCSGCGSLSLPIYIWAPLAGTCGVLLLSLVITKRGRKKLLYIFKQPFMRPVQTTQEEDGCSCRFPEEEEGGCELGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 92 - protein, 1317 aa, Artificial Sequence
  synthetic polypeptide
ALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGKPIPNPLLGLDSTNGAATTTPAPRPPTPAPTIALQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSGSGSDIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSGSGEGRGSLLTCGDVEENPGPMIHLGHILFLLLLPVAAAQTTPGERSSLPAFYPGTSGSCSGCGSLSLPIYIWAPLAGTCGVLLLSLVITKRGRKKLLYIFKQPFMRPVQTTQEEDGCSCRFPEEEEGGCELGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 93 - protein, 1359 aa, Artificial Sequence
  synthetic polypeptide
ALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGKPIPNPLLGLDSTNGAATTTPAPRPPTPAPTIALQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELGSGSDIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSGSGEGRGSLLTCGDVEENPGPMIHLGHILFLLLLPVAAAQTTPGERSSLPAFYPGTSGSCSGCGSLSLPIYIWAPLAGTCGVLLLSLVITKRGRKKLLYIFKQPFMRPVQTTQEEDGCSCRFPEEEEGGCELGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 94 - protein, 242 aa, Artificial Sequence
  synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 95 - protein, 33 aa, Artificial Sequence
  synthetic polypeptide
GELDELVYLLDGPGYDPIHCDVVTRGGSHLFNF

SEQ ID NO: 96 - protein, 47 aa, Artificial Sequence
  synthetic polypeptide
IHLGHILFLLLLPVAAAQTTPGERSSLPAFYPGTSGSCSGCGSLSLP

SEQ ID NO: 97 - protein, 21 aa, Artificial Sequence
  synthetic polypeptide
IYIWAPLAGTCGVLLLSLVIT

SEQ ID NO: 98 - protein, 12 aa, Artificial Sequence
  synthetic polypeptide
GSVVIVGRIILS

SEQ ID NO: 99 - protein, 179 aa, Artificial Sequence
  synthetic polypeptide
ITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRS

SEQ ID NO: 100 - protein, 236 aa, Artificial Sequence
  synthetic polypeptide
MVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 101 - protein, 229 aa, Artificial Sequence
  synthetic polypeptide
SSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNH

SEQ ID NO: 102 - protein, 21 aa, Artificial Sequence
  synthetic polypeptide
GSGEGRGSLLTCGDVEENPGP

SEQ ID NO: 103 - protein, 189 aa, Artificial Sequence
  synthetic polypeptide
APITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSS

SEQ ID NO: 104 - protein, 4 aa, Artificial Sequence
  synthetic polypeptide
GSGS

SEQ ID NO: 105 - protein, 233 aa, Artificial Sequence
  synthetic polypeptide
DIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKS

SEQ ID NO: 106 - DNA, 3360 bp, Artificial Sequence
  synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccgggggtaccgaattcagcgggtcaggcggatctggaagtggtggtggagaacttgatgaattggtatacttactagatgggccaggttatgaccctatacattgcgatgtagtgacaaggggcggcagccaccttttcaattttggaagcggagctactaacttcagcctgctgaagcaggctggagacgtggaggagaaccctggacctatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 107 - DNA, 3360 bp, Artificial Sequence
  synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccgggggtaccgaattcagcgggtcaggcggatctggaagtggtggtggagaacttgatgaattggtatacttactagatgggccaggttatgaccctatacattgcgatgtagtgacaaggggcggcagccaccttttcaattttggaagcggagctactaacttcagcctgctgaagcaggctggagacgtggaggagaaccctggacctatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 108 - DNA, 3234 bp, Artificial Sequence
  synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccgggggtaccgaattcagcgggtcaggcggatctggaagtggtggtggagaacttgatgaattggtatacttactagatgggccaggttatgaccctatacattgcgatgtagtgacaaggggcggcagccaccttttcaattttggaagcggagctactaacttcagcctgctgaagcaggctggagacgtggaggagaaccctggacctatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 109 - DNA, 3234 bp, Artificial Sequence
  synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccgggggtaccgaattcagcgggtcaggcggatctggaagtggtggtggagaacttgatgaattggtatacttactagatgggccaggttatgaccctatacattgcgatgtagtgacaaggggcggcagccaccttttcaattttggaagcggagctactaacttcagcctgctgaagcaggctggagacgtggaggagaaccctggacctatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgctcctgctgagtctggttattaccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 110 - DNA, 3486 bp, Artificial Sequence
  synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactggggggtaccgaattcagcgggtcaggcggatctggaagtggtggtggagaacttgatgaattggtatacttactagatgggccaggttatgaccctatacattgcgatgtagtgacaaggggcggcagccaccttttcaattttggaagcggagctactaacttcagcctgctgaagcaggctggagacgtggaggagaaccctggacctatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 111 - DNA, 3486 bp, Artificial Sequence
  synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactggggggtaccgaattcagcgggtcaggcggatctggaagtggtggtggagaacttgatgaattggtatacttactagatgggccaggttatgaccctatacattgcgatgtagtgacaaggggcggcagccaccttttcaattttggaagcggagctactaacttcagcctgctgaagcaggctggagacgtggaggagaaccctggacctatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 112 - DNA, 3360 bp, Artificial Sequence
  synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactggggggtaccgaattcagcgggtcaggcggatctggaagtggtggtggagaacttgatgaattggtatacttactagatgggccaggttatgaccctatacattgcgatgtagtgacaaggggcggcagccaccttttcaattttggaagcggagctactaacttcagcctgctgaagcaggctggagacgtggaggagaaccctggacctatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 113 - DNA, 3360 bp, Artificial Sequence
  synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactggggggtaccgaattcagcgggtcaggcggatctggaagtggtggtggagaacttgatgaattggtatacttactagatgggccaggttatgaccctatacattgcgatgtagtgacaaggggcggcagccaccttttcaattttggaagcggagctactaacttcagcctgctgaagcaggctggagacgtggaggagaaccctggacctatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgctcctgctgagtctggttattaccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 114 - protein, 1118 aa, Artificial Sequence
  synthetic polypeptide
ALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGKPIPNPLLGLDSTNGAATTTPAPRPPTPAPTIALQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSGGTEFSGSGGSGSGGGELDELVYLLDGPGYDPIHCDVVTRGGSHLFNFGSGATNFSLLKQAGDVEENPGPMIHLGHILFLLLLPVAAAQTTPGERSSLPAFYPGTSGSCSGCGSLSLPIYIWAPLAGTCGVLLLSLVITKRGRKKLLYIFKQPFMRPVQTTQEEDGCSCRFPEEEEGGCELGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 115 - protein, 1118 aa, Artificial Sequence
  synthetic polypeptide
ALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGKPIPNPLLGLDSTNGAATTTPAPRPPTPAPTIALQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSGGTEFSGSGGSGSGGGELDELVYLLDGPGYDPIHCDVVTRGGSHLFNFGSGATNFSLLKQAGDVEENPGPMIHLGHILFLLLLPVAAAQTTPGERSSLPAFYPGTSGSCSGCGSLSLPIYIWAPLAGTCGVLLLSLVITKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSGMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 116 - protein, 1076 aa, Artificial Sequence
  synthetic polypeptide
ALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGKPIPNPLLGLDSTNGAATTTPAPRPPTPAPTIALQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSGGTEFSGSGGSGSGGGELDELVYLLDGPGYDPIHCDVVTRGGSHLFNFGSGATNFSLLKQAGDVEENPGPMIHLGHILFLLLLPVAAAQTTPGERSSLPAFYPGTSGSCSGCGSLSLPIYIWAPLAGTCGVLLLSLVITGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 117 - protein, 1076 aa, Artificial Sequence
  synthetic polypeptide
ALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGKPIPNPLLGLDSTNGAATTTPAPRPPTPAPTIALQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSGGTEFSGSGGSGSGGGELDELVYLLDGPGYDPIHCDVVTRGGSHLFNFGSGATNFSLLKQAGDVEENPGPMIHLGHILFLLLLPVAAAQTTPGERSSLPAFYPGTSGSCSGCGSLSLPIYIWAPLAGTCGVLLLSLVITRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSGMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 118 - protein, 1160 aa, Artificial Sequence
  synthetic polypeptide
ALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGKPIPNPLLGLDSTNGAATTTPAPRPPTPAPTIALQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELGGTEFSGSGGSGSGGGELDELVYLLDGPGYDPIHCDVVTRGGSHLFNFGSGATNFSLLKQAGDVEENPGPMIHLGHILFLLLLPVAAAQTTPGERSSLPAFYPGTSGSCSGCGSLSLPIYIWAPLAGTCGVLLLSLVITKRGRKKLLYIFKQPFMRPVQTTQEEDGCSCRFPEEEEGGCELGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 119 - protein, 1160 aa, Artificial Sequence
  synthetic polypeptide
ALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGKPIPNPLLGLDSTNGAATTTPAPRPPTPAPTIALQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELGGTEFSGSGGSGSGGGELDELVYLLDGPGYDPIHCDVVTRGGSHLFNFGSGATNFSLLKQAGDVEENPGPMIHLGHILFLLLLPVAAAQTTPGERSSLPAFYPGTSGSCSGCGSLSLPIYIWAPLAGTCGVLLLSLVITKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSGMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 120 - protein, 1118 aa, Artificial Sequence
  synthetic polypeptide
ALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGKPIPNPLLGLDSTNGAATTTPAPRPPTPAPTIALQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELGGTEFSGSGGSGSGGGELDELVYLLDGPGYDPIHCDVVTRGGSHLFNFGSGATNFSLLKQAGDVEENPGPMIHLGHILFLLLLPVAAAQTTPGERSSLPAFYPGTSGSCSGCGSLSLPIYIWAPLAGTCGVLLLSLVITGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 121 - protein, 1118 aa, Artificial Sequence
  synthetic polypeptide
ALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGKPIPNPLLGLDSTNGAATTTPAPRPPTPAPTIALQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELGGTEFSGSGGSGSGGGELDELVYLLDGPGYDPIHCDVVTRGGSHLFNFGSGATNFSLLKQAGDVEENPGPMIHLGHILFLLLLPVAAAQTTPGERSSLPAFYPGTSGSCSGCGSLSLPIYIWAPLAGTCGVLLLSLVITRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSGMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 122 - DNA, 66 bp, Artificial Sequence
  synthetic polynucleotide
ggaagcggagctactaacttcagcctgctgaagcaggctggagacgtggaggagaaccctggacct

SEQ ID NO: 123 - protein, 22 aa, Artificial Sequence
  synthetic polypeptide
GSGATNFSLLKQAGDVEENPGP

SEQ ID NO: 124 - DNA, 63 bp, Artificial Sequence
  synthetic polynucleotide
atatacatctgggctcctctggctggcacttgcggagtgctcctgctgagtctggttattacc

SEQ ID NO: 125 - DNA, 3915 bp, Artificial Sequence
  synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccggctcaggaagctcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcatggcagtggagagggcagaggaagtctgctaacatgcggtgacgtcgaggagaatcctggcccaatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgggctgcgtggtcatagtgggcaggatcgtcttgtccggatccggcactagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 126 - DNA, 3927 bp, Artificial Sequence
  synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccggctcaggaagcgatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtccggcagtggagagggcagaggaagtctgctaacatgcggtgacgtcgaggagaatcctggcccaatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgggctgcgtggtcatagtgggcaggatcgtcttgtccggatccggcactagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 127 - protein, 1303 aa, Artificial Sequence
  synthetic polypeptide
ALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGKPIPNPLLGLDSTNGAATTTPAPRPPTPAPTIALQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSGSGSSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHGSGEGRGSLLTCGDVEENPGPMIHLGHILFLLLLPVAAAQTTPGERSSLPAFYPGTSGSCSGCGSLSLPIYIWAPLAGTCGVLLLSLVITKRGRKKLLYIFKQPFMRPVQTTQEEDGCSCRFPEEEEGGCELGCVVIVGRIVLSGSGTSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 128 - protein, 1307 aa, Artificial Sequence
  synthetic polypeptide
ALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGKPIPNPLLGLDSTNGAATTTPAPRPPTPAPTIALQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSGSGSDIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSGSGEGRGSLLTCGDVEENPGPMIHLGHILFLLLLPVAAAQTTPGERSSLPAFYPGTSGSCSGCGSLSLPIYIWAPLAGTCGVLLLSLVITKRGRKKLLYIFKQPFMRPVQTTQEEDGCSCRFPEEEEGGCELGCVVIVGRIVLSGSGTSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 129 - protein, 180 aa, Artificial Sequence
  synthetic polypeptide
APITAYAQQTRGLLGCIITSLTGRDKNQVEGEVQIVSTATQTFLATCINGVCWTVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMR

SEQ ID NO: 130 - protein, 180 aa, Artificial Sequence
  synthetic polypeptide
APITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSSGGPLLCPSGHAVGIFRAAVCTRGVAKAVDFVPVESMETTMR

SEQ ID NO: 131 - protein, 180 aa, Artificial Sequence
  synthetic polypeptide
APITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTR

SEQ ID NO: 132 - protein, 180 aa, Artificial Sequence
  synthetic polypeptide
APITAYAQQTRGLLGTIVTSLTGRDKNVVTGEVQVLSTATQTFLGTTVGGVIWTVYHGAGSRTLAGAKHPALQMYTNVDQDLVGWPAPPGAKSLEPCACGSSDLYLVTRDADVIPARRRGDSTASLLSPRPLACLKGSSGGPVMCPSGHVAGIFRAAVCTRGVAKSLQFIPVETLSTQAR

SEQ ID NO: 133 - protein, 180 aa, Artificial Sequence
  synthetic polypeptide
APITAYAQQTRGLFSTIVTSLTGRDTNENCGEVQVLSTATQSFLGTAVNGVMWTVYHGAGAKTISGPKGPVNQMYTNVDQDLVGWPAPPGVRSLAPCTCGSADLYLVTRHADVIPVRRRGDTRGALLSPRPISILKGSSGGPLLCPMGHRAGIFRAAVCTRGVAKAVDFVPVESLETTMR

SEQ ID NO: 134 - protein, 180 aa, Artificial Sequence
  synthetic polypeptide
APITAYAQQTRGVLGAIVLSLTGRDKNEAEGEVQFLSTATQTFLGICINGVMWTLFHGAGSKTLAGPKGPVVQMYTNVDKDLVGWPSPPGKGSLTRCTCGSADLYLVTRHADVIPARRRGDTRASLLSPRPISYLKGSSGGPIMCPSGHVVGVFRAAVCTRGVAKALEFVPVENLETTMR

SEQ ID NO: 135 - protein, 180 aa, Artificial Sequence
  synthetic polypeptide
APITAYAQQTRGLVGTIVTSLTGRDKNEAEGEVQVVSTATQSFLATTINGVLWTVYHGAGSKNLAGPKGPVCQMYTNVDQDLVGWPAPLGARSLAPCTCGSSDLYLVTRGADVIPARRRGDTRAALLSPRPISTLKGSSGGPLMCPSGHVVGLFRAAVCTRGVAKALDFIPVENMDTTMR

SEQ ID NO: 136 - protein, 180 aa, Artificial Sequence
  synthetic polypeptide
APISAYAQQTRGLISTLVVSLTGRDKNETAGEVQVLSTSTQTFLGTNVGGVMWGPYHGAGTRTVAGRGGPVLQMYTSVSDDLVGWPAPPGSKSLEPCSCGSADLYLVTRNADVLPLRRKGDGTASLLSPRPVSSLKGSSGGPVLCPQSHCVGIFRAAVCTRGVAKAVQFVPIEKMQVAQR

SEQ ID NO: 137 - protein, 14 aa, Artificial Sequence
  synthetic polypeptide
GCVVIVGRIVLSGK

SEQ ID NO: 138 - protein, 14 aa, Artificial Sequence
  synthetic polypeptide
GCVCIIGRLHINQR

SEQ ID NO: 139 - protein, 14 aa, Artificial Sequence
  synthetic polypeptide
GCVVIVGHIELEGK

SEQ ID NO: 140 - protein, 14 aa, Artificial Sequence
  synthetic polypeptide
GSVVIVGRVVLSGQ

SEQ ID NO: 141 - protein, 14 aa, Artificial Sequence
  synthetic polypeptide
GSVAIVGRIILSGR

SEQ ID NO: 142 - protein, 14 aa, Artificial Sequence
  synthetic polypeptide
GCVVICGRIVTSGK

SEQ ID NO: 143 - protein, 14 aa, Artificial Sequence
  synthetic polypeptide
GSVVVVGRVVLGSN

SEQ ID NO: 144 - protein, 54 aa, Artificial Sequence
  synthetic polypeptide
STWVLVGGVLAALAAYCLSTGCVVIVGRIVLSGKPAIIPDREVLYQEFDEMEEC

SEQ ID NO: 145 - protein, 54 aa, Artificial Sequence
  synthetic polypeptide
STWVLVGGVLAALAAYCLSTGCVVIVGRVVLSGKPAIIPDREVLYREFDEMEEC

SEQ ID NO: 146 - protein, 54 aa, Artificial Sequence
  synthetic polypeptide
STWVLVGGVLAALAAYCLSTGCVVIVGRIVLSGRPAIIPDREVLYREFDEMEEC

SEQ ID NO: 147 - protein, 54 aa, Artificial Sequence
  synthetic polypeptide
STWVLVGGVLAALAAYCLTTGSVVIVGRIILSGRPAIVPDRELLYQEFDEMEEC

SEQ ID NO: 148 - protein, 54 aa, Artificial Sequence
  synthetic polypeptide
STWVLVGGVLAALAAYCLTTGSVVIVGRIILSGRPAIIPDRELLYQEFDEMEEC

SEQ ID NO: 149 - protein, 54 aa, Artificial Sequence
  synthetic polypeptide
STWVLVGGVLAALAAYCLTTGSVVIVGRIILSGKPAVVPDRELLYQEFDEMEEC

SEQ ID NO: 150 - protein, 54 aa, Artificial Sequence
  synthetic polypeptide
STWVLVGGVLAALAAYCLTTGSVVIVGRIILSGRPAVIPDRELLYREFDEMEEC

SEQ ID NO: 151 - protein, 54 aa, Artificial Sequence
  synthetic polypeptide
STWVLAGGVLAAVAAYCLATGCVCIIGRLHVNQRAVVAPDKEVLYEAFDEMEEC

SEQ ID NO: 152 - protein, 54 aa, Artificial Sequence
  synthetic polypeptide
STWVLAGGVLAAVAAYCLATGCVSIIGRLHINGRAVVAPDKEVLYEAFDEMEEC

SEQ ID NO: 153 - protein, 54 aa, Artificial Sequence
  synthetic polypeptide
SSWVLAGGVLAAVAAYCLATGCISIIGRLHLNDRVVVAPDKEILYEAFDEMEEC

SEQ ID NO: 154 - protein, 54 aa, Artificial Sequence
  synthetic polypeptide
STWVLAGGVLAAVAAYCLATGCVSIIGRLHLNDQVVVTPDKEILYEAFDEMEEC

SEQ ID NO: 155 - protein, 54 aa, Artificial Sequence
  synthetic polypeptide
STWVLLGGVLAALAAYCLSVGCVVIVGHIELEGKPALVPDKEVLYQQYDEMEEC

SEQ ID NO: 156 - protein, 54 aa, Artificial Sequence
  synthetic polypeptide
STWVLLGGVLAAVAAYCLSVGCVVIVGHIELGGKPALVPDKEVLYQQYDEMEEC

SEQ ID NO: 157 - protein, 4 aa, Artificial Sequence
  synthetic polypeptide
SGTS

SEQ ID NO: 158 - protein, 4 aa, Artificial Sequence
  synthetic polypeptide
GSGS

SEQ ID NO: 159 - protein, 20 aa, Artificial Sequence
  synthetic polypeptide
CMSADLEVVTSTWVLVGGVL

SEQ ID NO: 160 - protein, 20 aa, Artificial Sequence
  synthetic polypeptide
CMSADLEVVTSTWVLVGGVL

SEQ ID NO: 161 - protein, 20 aa, Artificial Sequence
  synthetic polypeptide
CMQADLEVMTSTWVLAGGVL

SEQ ID NO: 162 - protein, 20 aa, Artificial Sequence
  synthetic polypeptide
CMQADLEIMTSSWVLAGGVL

SEQ ID NO: 163 - protein, 20 aa, Artificial Sequence
  synthetic polypeptide
CMSADLEVTTSTWVLLGGVL

SEQ ID NO: 164 - protein, 20 aa, Artificial Sequence
  synthetic polypeptide
YQEFDEMEECSQHLPYIEQG

SEQ ID NO: 165 - protein, 20 aa, Artificial Sequence
  synthetic polypeptide
YQEFDEMEECASHLPYIEQG

SEQ ID NO: 166 - protein, 20 aa, Artificial Sequence
  synthetic polypeptide
YEAFDEMEECASRAALIEEG

SEQ ID NO: 167 - protein, 20 aa, Artificial Sequence
  synthetic polypeptide
YEAFDEMEECASKAALIEEG

SEQ ID NO: 168 - protein, 20 aa, Artificial Sequence
  synthetic polypeptide
YQQYDEMEECSQAAPYIEQA

SEQ ID NO: 169 - protein, 20 aa, Artificial Sequence
  synthetic polypeptide
WISSECTTPCSGSWLRDVWD

SEQ ID NO: 170 - protein, 20 aa, Artificial Sequence
  synthetic polypeptide
WINEDCSTPCSGSWLRDVWD

SEQ ID NO: 171 - protein, 20 aa, Artificial Sequence
  synthetic polypeptide
WITEDCPIPCSGSWLRDVWD

SEQ ID NO: 172 - protein, 20 aa, Artificial Sequence
  synthetic polypeptide
WITEDCPVPCSGSWLQDIWD

SEQ ID NO: 173 - protein, 20 aa, Artificial Sequence
  synthetic polypeptide
WINEDYPSPCSDDWLRTIWD

SEQ ID NO: 174 - protein, 20 aa, Artificial Sequence
  synthetic polypeptide
GADTEDVVCCSMSYSWTGAL

SEQ ID NO: 175 - protein, 20 aa, Artificial Sequence
  synthetic polypeptide
EEASEDVVCCSMSYTWTGAL

SEQ ID NO: 176 - protein, 20 aa, Artificial Sequence
  synthetic polypeptide
SEEDDSVVCCSMSYSWTGAL

SEQ ID NO: 177 - protein, 20 aa, Artificial Sequence
  synthetic polypeptide
SDQEDSVICCSMSYSWTGAL

SEQ ID NO: 178 - protein, 20 aa, Artificial Sequence
  synthetic polypeptide
DSEEQSVVCCSMSYSWTGAL

SEQ ID NO: 179 - protein, 180 aa, Artificial Sequence
  synthetic polypeptide
APITAYAQQTRGLLGCIITSLTGRDKNQVEGEVQIVSTATQTFLATCINGVCWTVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVTKAVDFIPVENLETTMR

SEQ ID NO: 180 - protein, 180 aa, Artificial Sequence
  synthetic polypeptide
APITAYSQQTRGLLGCIITSLTGRDKNQVEGEVQVVSTATQSFLATCVNGVCWTVYHGAGSKTLAAPKGPITQMYTNVDQDLVGWPKPPGARSLTPCTCGSSDLYLVTRHADVIPVRRRGDSRGSLLSPRPVSYLKGSSGGPLLCPFGHAVGIFRAAVCTRGVAKAVDFVPVESMETTMR

SEQ ID NO: 181 - protein, 180 aa, Artificial Sequence
  synthetic polypeptide
APITAYAQQTRGLLGTIVVSMTGRDKTEQAGEIQVLSTVTQSFLGTTISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTR

SEQ ID NO: 182 - protein, 180 aa, Artificial Sequence
  synthetic polypeptide
APITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVATR

SEQ ID NO: 183 - protein, 180 aa, Artificial Sequence; identical to SEQ ID NO: 132
  synthetic polypeptide

SEQ ID NO: 184 - protein, 182 aa, Artificial Sequence
  synthetic polypeptide
MAPITAYAQQTRGLLGCIITSLTGRDKNQVEGEVQIVSTAAQTFLATCINGVCWTVYHGAGTRTIASPKGPVIQMYTNVDKDLVGWPAPQGSRSLTPCTCGSSDLYLVTRHADVIPVRRRGDSRGSLLSPRPISYLKGSSGGPLLCPAGHAVGIFRAAVCTRGVAKAVDFIPVESLETTMRS

SEQ ID NO: 185 - protein, 195 aa, Artificial Sequence
  synthetic polypeptide
MKKKGSVVIVGRIVLNGAYAQQTRGLLGCIITSLTGRDKNQVEGEVQIVSTAAQTFLATCINGVCWTVYHGAGTRTIASPKGPVIQMYTNVDKDLVGWPAPQGSRSLTPCTCGSSDLYLVTRHADVIPVRRRGDSRGSLLSPRPISYLKGSSGGPLLCPAGHAVGIFRAAVCTRGVAKAVDFIPVESLETTMRSP

SEQ ID NO: 186 - protein, 195 aa, Artificial Sequence
  synthetic polypeptide
MKKKGSVVIVGRIVLNGAYAQQTRGEEGCQETSQTGRDKNQVEGEVQIVSTAAQTFLATCINGVCWTVYHGAGTRTIASPKGPVIQMYTNVDKDLVGWPAPQGSRSLTPCTCGSSDLYLVTRHADVIPVRRRGDSRGSLLSPRPISYLKGSSGGPLLCPAGHAVGIFRAAVCTRGVAKAVDFIPVESLETTMRSP

SEQ ID NO: 187 - protein, 197 aa, Artificial Sequence
  synthetic polypeptide
MKKKGSVVIVGRINLSGDTAYAQQTRGEEGCQETSQTGRDKNQVEGEVQIVSTAAQTFLATCINGVCWTVYHGAGTRTIASPKGPVIQMYTNVDKDLVGWPAPQGSRSLTPCTCGSSDLYLVTRHADVIPVRRRGDSRGSLLSPRPISYLKGSSGGPLLCPAGHAVGIFRAAVCTRGVAKAVDFIPVESLETTMRSP

SEQ ID NO: 188 - protein, 197 aa, Artificial Sequence
  synthetic polypeptide
MKKKGSVVIVGRINLSGDTAYAQQTRGEEGCQETSQTGRDKNQVEGEVQIVSTATQTFLATCINGVCWTVYHGAGTRTIASPKGPVTQMYTNVDKDLVGWQAPQGSRSLTPCTCGSSDLYLVTRHADVIPVRRRGDSRGSLLSPRPISYLKGSSGGPLLCPAGHAVGIFRAAVCTRGVAKAVDFIPVESLETTMRSP

SEQ ID NO: 189 - protein, 197 aa, Artificial Sequence
  synthetic polypeptide
MKKKGSVVIVGRINLSGDTAYAQQTRGEEGCQETSQTGRDKNQVEGEVQIVSTATQTFLATSINGVLWTVYHGAGTRTIASPKGPVTQMYTNVDKDLVGWQAPQGSRSLTPCTCGSSDLYLVTRHADVIPVRRRGDSRGSLLSPRPISYLKGSSGGPLLCPAGHAVGIFRAAVSTRGVAKAVDFIPVESLETTMRSP

SEQ ID NO: 190 - protein, 197 aa, Artificial Sequence
  synthetic polypeptide
MKKKGSVVIVGRINLSGDTAYAQQTRGEQGCQKTSHTGRDKNQVEGEVQIVSTATQTFLATSINGVLWTVYHGAGTRTIASPKGPVTQMYTNVDKDLVGWQAPQGSRSLTPCTCGSSDLYLVTRHADVIPVRRRGDSRGSLLSPRPISYLKGSSGGPLLCPAGHAVGIFRAAVSTRGVAKAVDFIPVESLETTMRSP

SEQ ID NO: 191 - protein, 197 aa, Artificial Sequence
  synthetic polypeptide
MKKKGSVVIVGRINLSGDTAYAQQTRGEQGTQKTSHTGRDKNQVEGEVQIVSTATQTFLATSINGVLWTVYHGAGTRTIASPKGPVTQMYTNVDKDLVGWQAPQGSRSLTPCTCGSSDLYLVTRHADVIPVRRRGDSRGSLLSPRPISYLKGSSGGPLLCPAGHAVGIFRAAVSTRGVAKAVDFIPVESLETTMRSP

SEQ ID NO: 192 - protein, 33 aa, Artificial Sequence
  synthetic polypeptide
GELGRLVYLLDGPGYDPIHCSLAYGDASTLVVF

SEQ ID NO: 193 - protein, 18 aa, Artificial Sequence
  synthetic polypeptide
GELGRLVYLLDGPGYDPI

SEQ ID NO: 194 - protein, 15 aa, Artificial Sequence
  synthetic polypeptide
HCSLAYGDASTLVVF

SEQ ID NO: 195 - protein, 33 aa, Artificial Sequence
  synthetic polypeptide
GELGRPVYVLGDPGYYATHCIYATTNDALIFSV

SEQ ID NO: 196 - protein, 18 aa, Artificial Sequence
  synthetic polypeptide
GELGRPVYVLGDPGYYAT

SEQ ID NO: 197 - protein, 15 aa, Artificial Sequence
  synthetic polypeptide
HCIYATTNDALIFSV

SEQ ID NO: 198 - protein, 33 aa, Artificial Sequence
  synthetic polypeptide
GELGRIPSDTYDLAVGALHCPFYLVSGLVYLDG

SEQ ID NO: 199 - protein, 33 aa, Artificial Sequence
  synthetic polypeptide
GELGRLVYLLDGPGYDPIHCDVVTRGGSHLFNF

SEQ ID NO: 200 - protein, 33 aa, Artificial Sequence; identical to SEQ ID NO: 95
  synthetic polypeptide

SEQ ID NO: 201 - protein, 21 aa, Artificial Sequence
  synthetic polypeptide
GELGRLVYLLDGPGYDPIHCD

SEQ ID NO: 202 - protein, 20 aa, Artificial Sequence
  synthetic polypeptide
GELDELVYLLDGPGYDPIHS

SEQ ID NO: 203 - protein, 36 aa, Artificial Sequence
  synthetic polypeptide
RQIKIWFQNRRMKWKKGELDELVYLLDGPGYDPIHS

SEQ ID NO: 204 - protein, 21 aa, Artificial Sequence
  synthetic polypeptide
GELDELVYLLDGPGYDPIHSD

SEQ ID NO: 205 - protein, 196 aa, Artificial Sequence
  synthetic polypeptide
KKKGSVVIVGRINLSGDTAYAQQTRGEEGCQETSQTGRDKNQVEGEVQIVSTATQTFLATSINGVLWTVYHGAGTRTIASPKGPVTQMYTNVDKDLVGWQAPQGSRSLTPCTCGSSDLYLVTRHADVIPVRRRGDSRGSLLSPRPISYLKGSAGGPLLCPAGHAVGIFRAAVSTRGVAKAVDFIPVESLETTMRSP

SEQ ID NO: 206 - protein, 229 aa, Artificial Sequence
  synthetic polypeptide
SSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALLTIVIAIEAAVNALEAAERTGDPEVRELARELVRLAVEAAEEVQRNPSSREVNIALWKIVLAIQEAVESLREAEESGDPEKREKARERVREAVERAEEVQRDPSGWLNH

SEQ ID NO: 207 - protein, 229 aa, Artificial Sequence
  synthetic polypeptide
SSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALLSIVIAIEAAVHALEAAERTGDPEVRELARELVRLAVEAAEEVQRNPSSREVEHALMKIVLAIYEAEESLREAEESGDPEKREKARERVREAVERAEEVQRDPSGWLNH

SEQ ID NO: 208 - protein, 233 aa, Artificial Sequence
  synthetic polypeptide
DIEKLCKKAEEEAKEAQEKADELRQRHPDSQAAEDAEDLANEAEAAVLAACSLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKS

SEQ ID NO: 209 - protein, 21 aa, Artificial Sequence
  synthetic polypeptide
GSGEGRGSLLTCGDVEENPGP

SEQ ID NO: 210 - protein, 22 aa, Artificial Sequence
  synthetic polypeptide
GSGATNFSLLKQAGDVEENPGP

SEQ ID NO: 211 - protein, 23 aa, Artificial Sequence
  synthetic polypeptide
GSGQCTNYALLKLAGDVESNPGP

SEQ ID NO: 212 - protein, 25 aa, Artificial Sequence
  synthetic polypeptide
GSGVKQTLNFDLLKLAGDVESNPGP

SEQ ID NO: 213 - DNA, 26 bp, Artificial Sequence
  synthetic oligonucleotide
ggttctgttgttattgttggtagaat

SEQ ID NO: 214 - DNA, 25 bp, Artificial Sequence
  synthetic oligonucleotide
ggtaataaccagactcagcagaagc

SEQ ID NO: 215 - DNA, 50 bp, Artificial Sequence
  synthetic oligonucleotide
gcttctgctgagtctggttattaccggttctgttgttattgttggtagaa

SEQ ID NO: 216 - DNA, 50 bp, Artificial Sequence
  synthetic oligonucleotide
ctgcgctcctgctgaacttcactctagaccgcatggtagtttccatagac

SEQ ID NO: 217 - DNA, 25 bp, Artificial Sequence
  synthetic oligonucleotide
agagtgaagttcagcaggagcgcag

SEQ ID NO: 218 - DNA, 46 bp, Artificial Sequence
  synthetic oligonucleotide
ctgcgctcctgctgaacttcactctggtaataaccagactcagcag

SEQ ID NO: 219 - DNA, 51 bp, Artificial Sequence
  synthetic oligonucleotide
attctaccaacaataacaacagaaccgcgagggggcagggcctgcatgtga

SEQ ID NO: 220 - DNA, 57 bp, Artificial Sequence
  synthetic oligonucleotide
atgttatcctcctcgcccttgctcaccatgccagaccgcatggtagtttccatagac

SEQ ID NO: 221 - DNA, 29 bp, Artificial Sequence
  synthetic oligonucleotide
atggtgagcaagggcgaggaggataacat

SEQ ID NO: 222 - DNA, 25 bp, Artificial Sequence
  synthetic oligonucleotide
ggagcgataggctgcgaagtcgcgt

SEQ ID NO: 223 - DNA, 55 bp, Artificial Sequence
  synthetic oligonucleotide
gcctgacccgctgaattcggtaccccccagttcacatcctccttcttcttcttct

SEQ ID NO: 224 - DNA, 25 bp, Artificial Sequence
  synthetic oligonucleotide
ggctcaggaagctcttccgacgaag

SEQ ID NO: 225 - DNA, 50 bp, Artificial Sequence
  synthetic oligonucleotide
cttcgtcggaagagcttcctgagccggagcgataggctgcgaagtcgcgt

SEQ ID NO: 226 - DNA, 25 bp, Artificial Sequence
  synthetic oligonucleotide
atgattcagccaaccggatggatca

SEQ ID NO: 227 - DNA, 50 bp, Artificial Sequence
  synthetic oligonucleotide
tgatccatccggttggctgaatcatggcagtggagagggcagaggaagtc

SEQ ID NO: 228 - DNA, 50 bp, Artificial Sequence
  synthetic oligonucleotide
gcttctcgatatcgcttcctgagccggagcgataggctgcgaagtcgcgt

SEQ ID NO: 229 - DNA, 25 bp, Artificial Sequence
  synthetic oligonucleotide
ggctcaggaagcgatatcgagaagc

SEQ ID NO: 230 - DNA, 25 bp, Artificial Sequence
  synthetic oligonucleotide
ggacttacagcgttcttttacctcc

SEQ ID NO: 231 - DNA, 50 bp, Artificial Sequence
  synthetic oligonucleotide
ggaggtaaaagaacgctgtaagtccggcagtggagagggcagaggaagtc

SEQ ID NO: 232 - DNA, 25 bp, Artificial Sequence
  synthetic oligonucleotide
ggctgcgtggtcatagtgggcagga

SEQ ID NO: 233 - DNA, 25 bp, Artificial Sequence
  synthetic oligonucleotide
cagttcacatcctccttcttcttct

SEQ ID NO: 234 - DNA, 50 bp, Artificial Sequence
  synthetic oligonucleotide
tcctgcccactatgaccacgcagcccagttcacatcctccttcttcttct

SEQ ID NO: 235 - DNA, 25 bp, Artificial Sequence
  synthetic oligonucleotide
agagtgaagttcagcaggagcgcag

SEQ ID NO: 236 - DNA, 10600 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagccccgataaaataaaagattttatttagtctccagaaaaaggggggaatgaaagaccccacctgtaggtttggcaagctagctgcagtaacgccattttgcaaggcatggaaaaataccaaaccaagaatagagaagttcagatcaagggcgggtacatgaaaatagctaacgttgggccaaacaggatatctgcggtgagcagtttcggccccggcccggggccaagaacagatggtcaccgcagtttcggccccggcccgaggccaagaacagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggggggatctggagctctcgagaattctcacgcgtgccgccaccatggccctgcctgtgacagctctgctgctgcctctggccctgctgctgcatgctgctagacctcaggtgcagctgcaggaaagcggccctggcctcgtgaagcctagcgagacactgagcctgacctgcaccgtgtccggctacagcatcaccagcaactactggggctggatcagacagccccctggcaagggcctggaatggatgggctacatcacctacagcggcagcaccagctacaaccccagcctgaagtcccggatcaccatcagccgggacaccagcaagaaccagttctccctgaagctgagcagcgtgacagccgccgataccgccgtgtactactgcgccatcaccaccttctactattggggccagggcaccctcgtgaccgtgtctagcggaggcggaggatctggcggcggaggaagtggcggagggggctctgatatccagatgacccagagccccagcagcctgtctgccagcgtgggcgacagagtgaccatcacctgtagagccagccaggacatcggcaactacctgcggtggttccagcagaagccaggcaaggcccccaagctgctgatctccggcgccacaaatctggccgctggcgtgccaagcagattcagcggctctggcagcggctccgacttcaccctgaccatctctagcctgcagcccgaggacttcgccacctactactgcctgcagagcaaagagagcccctggaccttcggacagggcaccaaggtggaaatcaagcggacagaacaaaaactcatctcagaagaagatctgaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccggcatcagtctgattgcggcgttagcggtagattacgttatcggcatggaaaacgccatgccgtggaacctgcctgccgatctcgcctggtttaaacgcaacaccttaaataaacccgtgattatgggccgccatacctgggaatcaatcggtcgtccgttgccaggacgcaaaaatattatcctcagcagtcaaccgagtacggacgatcgcgtaacgtgggtgaagtcggtggatgaagccatcgcggcgtgtggtgacgtaccagaaatcatggtgattggcggcggtcgcgttattgaacagttcttgccaaaagcgcaaaaactgtatctgacgcatatcgacgcagaagtggaaggcgacacccatttcccggattacgagccggatgactgggaatcggtattcagcgagttccacgatgctgatgcgcagaactctcacagctattgctttgagattctggagcggcgataagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 237 - DNA, 11293 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagccccgataaaataaaagattttatttagtctccagaaaaaggggggaatgaaagaccccacctgtaggtttggcaagctagctgcagtaacgccattttgcaaggcatggaaaaataccaaaccaagaatagagaagttcagatcaagggcgggtacatgaaaatagctaacgttgggccaaacaggatatctgcggtgagcagtttcggccccggcccggggccaagaacagatggtcaccgcagtttcggccccggcccgaggccaagaacagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggggggatctggagctctcgagaattctcacgcgtgccgccaccatggccttaccagtgaccgccttgctcctgccgctggccttgctgctccacgccgccaggccgaaatacctattgcctacggcagccgctggattgttattactcgcggcccagccggccatggcccaggtgcagctggtgcagtctggggcagaggtgaaaaagcccggggagtctctgaagatctcctgtaagggttctggatacagctttaccagctactggatcgcctgggtgcgccagatgcccgggaaaggcctggagtacatggggctcatctatcctggtgactctgacaccaaatacagcccgtccttccaaggccaggtcaccatctcagtcgacaagtccgtcagcactgcctacttgcaatggagcagtctgaagccctcggacagcgccgtgtatttttgtgcgagacatgacgtgggatattgcaccgaccggacttgcgcaaagtggcctgaatacttccagcattggggccagggcaccctggtcaccgtctcctcaggtggaggcggttcaggcggaggtggctctggcggtggcggatcgcagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatctatgatcacaccaatcggcccgcaggggtccctgaccgattctctggctccaagtctggcacctcagcctccctggccatcagtgggttccggtccgaggatgaggctgattattactgtgcctcctgggactacaccctctcgggctgggtgttcggcggagggaccaagctgaccgtcctaggtgggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtggaggacgtggtgtgctgccactcaatctacggcaagaagaagggtgatatcgacacctaccgatacataggctcttccgggacaggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgatagggaggttctctaccaggagttcgatgagatggaagagtgctctcagcactatccctacgatgtgcccgattacgctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaaactagtgcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 238 - DNA, 10986 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagcccgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggggatctggagctctcgagaattctcacgcgtgccgccaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccgggggtaccgaattcagcgggtcaggcggatctggaagtggtggtggagaacttgatgaattggtatacttactagatgggccaggttatgaccctatacattgcgatgtagtgacaaggggcggcagccaccttttcaatttttaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 239 - DNA, 11112 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagcccgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggggatctggagctctcgagaattctcacgcgtgccgccaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactggggggtaccgaattcagcgggtcaggcggatctggaagtggtggtggagaacttgatgaattggtatacttactagatgggccaggttatgaccctatacattgcgatgtagtgacaaggggcggcagccaccttttcaatttttaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 240 - DNA, 11625 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagcccgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggggatctggagctctcgagaattctcacgcgtgccgccaccatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 241 - DNA, 11625 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagcccgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggggatctggagctctcgagaattctcacgcgtgccgccaccatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 242 - DNA, 11499 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagcccgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggggatctggagctctcgagaattctcacgcgtgccgccaccatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 243 - DNA, 11499 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagcccgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggggatctggagctctcgagaattctcacgcgtgccgccaccatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 244 - DNA, 13602 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagcccgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggggatctggagctctcgagaattctcacgcgtgccgccaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccggctcaggaagctcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcatggcagtggagagggcagaggaagtctgctaacatgcggtgacgtcgaggagaatcctggcccaatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 245 - DNA, 13572 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagcccgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggggatctggagctctcgagaattctcacgcgtgccgccaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccggctcaggaagctcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcatggcagtggagagggcagaggaagtctgctaacatgcggtgacgtcgaggagaatcctggcccaatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgggctgcgtggtcatagtgggcaggatcgtcttgtccggatccggcactagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 246 - DNA, 13728 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagcccgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggggatctggagctctcgagaattctcacgcgtgccgccaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgggctcaggaagctcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcatggcagtggagagggcagaggaagtctgctaacatgcggtgacgtcgaggagaatcctggcccaatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 247 - DNA, 13614 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagcccgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggggatctggagctctcgagaattctcacgcgtgccgccaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccggctcaggaagcgatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtccggcagtggagagggcagaggaagtctgctaacatgcggtgacgtcgaggagaatcctggcccaatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 248 - DNA, 13584 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagcccgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggggatctggagctctcgagaattctcacgcgtgccgccaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccggctcaggaagcgatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtccggcagtggagagggcagaggaagtctgctaacatgcggtgacgtcgaggagaatcctggcccaatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgggctgcgtggtcatagtgggcaggatcgtcttgtccggatccggcactagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 249 - DNA, 13740 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagcccgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggggatctggagctctcgagaattctcacgcgtgccgccaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgggctcaggaagcgatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtccggcagtggagagggcagaggaagtctgctaacatgcggtgacgtcgaggagaatcctggcccaatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 250 - DNA, 11542 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagccccgataaaataaaagattttatttagtctccagaaaaaggggggaatgaaagaccccacctgtaggtttggcaagctagctgcagtaacgccattttgcaaggcatggaaaaataccaaaccaagaatagagaagttcagatcaagggcgggtacatgaaaatagctaacgttgggccaaacaggatatctgcggtgagcagtttcggccccggcccggggccaagaacagatggtcaccgcagtttcggccccggcccgaggccaagaacagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggggggatctggagctctcgagaattctcacgcgtgccgccaccatggccttaccagtgaccgccttgctcctgccgctggccttgctgctccacgccgccaggccgaaatacctattgcctacggcagccgctggattgttattactcgcggcccagccggccatggcccaggtgcagctggtgcagtctggggcagaggtgaaaaagcccggggagtctctgaagatctcctgtaagggttctggatacagctttaccagctactggatcgcctgggtgcgccagatgcccgggaaaggcctggagtacatggggctcatctatcctggtgactctgacaccaaatacagcccgtccttccaaggccaggtcaccatctcagtcgacaagtccgtcagcactgcctacttgcaatggagcagtctgaagccctcggacagcgccgtgtatttttgtgcgagacatgacgtgggatattgcaccgaccggacttgcgcaaagtggcctgaatacttccagcattggggccagggcaccctggtcaccgtctcctcaggtggaggcggttcaggcggaggtggctctggcggtggcggatcgcagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatctatgatcacaccaatcggcccgcaggggtccctgaccgattctctggctccaagtctggcacctcagcctccctggccatcagtgggttccggtccgaggatgaggctgattattactgtgcctcctgggactacaccctctcgggctgggtgttcggcggagggaccaagctgaccgtcctaggtgggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtggaggacgtggtgtgctgccactcaatctacggcaagaagaagggtgatatcgacacctaccgatacataggctcttccgggacaggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgatagggaggttctctaccaggagttcgatgagatggaagagtgctctcagcactatccctacgatgtgcccgattacgctaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaaactagtgcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 251 - DNA, 10720 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagccccgataaaataaaagattttatttagtctccagaaaaaggggggaatgaaagaccccacctgtaggtttggcaagctagctgcagtaacgccattttgcaaggcatggaaaaataccaaaccaagaatagagaagttcagatcaagggcgggtacatgaaaatagctaacgttgggccaaacaggatatctgcggtgagcagtttcggccccggcccggggccaagaacagatggtcaccgcagtttcggccccggcccgaggccaagaacagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggggggatctggagctctcgagaattctcacgcgtgccgccaccatggccttaccagtgaccgccttgctcctgccgctggccttgctgctccacgccgccaggccgaaatacctattgcctacggcagccgctggattgttattactcgcggcccagccggccatggcccaggtgcagctggtgcagtctggggcagaggtgaaaaagcccggggagtctctgaagatctcctgtaagggttctggatacagctttaccagctactggatcgcctgggtgcgccagatgcccgggaaaggcctggagtacatggggctcatctatcctggtgactctgacaccaaatacagcccgtccttccaaggccaggtcaccatctcagtcgacaagtccgtcagcactgcctacttgcaatggagcagtctgaagccctcggacagcgccgtgtatttttgtgcgagacatgacgtgggatattgcaccgaccggacttgcgcaaagtggcctgaatacttccagcattggggccagggcaccctggtcaccgtctcctcaggtggaggcggttcaggcggaggtggctctggcggtggcggatcgcagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatctatgatcacaccaatcggcccgcaggggtccctgaccgattctctggctccaagtctggcacctcagcctccctggccatcagtgggttccggtccgaggatgaggctgattattactgtgcctcctgggactacaccctctcgggctgggtgttcggcggagggaccaagctgaccgtcctaggtgggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaaactagtgcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 252 - DNA, 11542 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagccccgataaaataaaagattttatttagtctccagaaaaaggggggaatgaaagaccccacctgtaggtttggcaagctagctgcagtaacgccattttgcaaggcatggaaaaataccaaaccaagaatagagaagttcagatcaagggcgggtacatgaaaatagctaacgttgggccaaacaggatatctgcggtgagcagtttcggccccggcccggggccaagaacagatggtcaccgcagtttcggccccggcccgaggccaagaacagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggggggatctggagctctcgagaattctcacgcgtgccgccaccatggccttaccagtgaccgccttgctcctgccgctggccttgctgctccacgccgccaggccgaaatacctattgcctacggcagccgctggattgttattactcgcggcccagccggccatggcccaggtgcagctggtgcagtctggggcagaggtgaaaaagcccggggagtctctgaagatctcctgtaagggttctggatacagctttaccagctactggatcgcctgggtgcgccagatgcccgggaaaggcctggagtacatggggctcatctatcctggtgactctgacaccaaatacagcccgtccttccaaggccaggtcaccatctcagtcgacaagtccgtcagcactgcctacttgcaatggagcagtctgaagccctcggacagcgccgtgtatttttgtgcgagacatgacgtgggatattgcaccgaccggacttgcgcaaagtggcctgaatacttccagcattggggccagggcaccctggtcaccgtctcctcaggtggaggcggttcaggcggaggtggctctggcggtggcggatcgcagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatctatgatcacaccaatcggcccgcaggggtccctgaccgattctctggctccaagtctggcacctcagcctccctggccatcagtgggttccggtccgaggatgaggctgattattactgtgcctcctgggactacaccctctcgggctgggtgttcggcggagggaccaagctgaccgtcctaggtgggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccgaggacgtggtgtgctgccactcaatctacggcaagaagaagggtgatatcgacacctaccgatacataggctcttccgggacaggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgatagggaggttctctaccaggagttcgatgagatggaagagtgctctcagcactatccctacgatgtgcccgattacgctaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaaactagtgcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 253 - DNA, 11542 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagccccgataaaataaaagattttatttagtctccagaaaaaggggggaatgaaagaccccacctgtaggtttggcaagctagctgcagtaacgccattttgcaaggcatggaaaaataccaaaccaagaatagagaagttcagatcaagggcgggtacatgaaaatagctaacgttgggccaaacaggatatctgcggtgagcagtttcggccccggcccggggccaagaacagatggtcaccgcagtttcggccccggcccgaggccaagaacagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggggggatctggagctctcgagaattctcacgcgtgccgccaccatggccttaccagtgaccgccttgctcctgccgctggccttgctgctccacgccgccaggccgaaatacctattgcctacggcagccgctggattgttattactcgcggcccagccggccatggcccaggtgcagctggtgcagtctggggcagaggtgaaaaagcccggggagtctctgaagatctcctgtaagggttctggatacagctttaccagctactggatcgcctgggtgcgccagatgcccgggaaaggcctggagtacatggggctcatctatcctggtgactctgacaccaaatacagcccgtccttccaaggccaggtcaccatctcagtcgacaagtccgtcagcactgcctacttgcaatggagcagtctgaagccctcggacagcgccgtgtatttttgtgcgagacatgacgtgggatattgcaccgaccggacttgcgcaaagtggcctgaatacttccagcattggggccagggcaccctggtcaccgtctcctcaggtggaggcggttcaggcggaggtggctctggcggtggcggatcgcagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatctatgatcacaccaatcggcccgcaggggtccctgaccgattctctggctccaagtctggcacctcagcctccctggccatcagtgggttccggtccgaggatgaggctgattattactgtgcctcctgggactacaccctctcgggctgggtgttcggcggagggaccaagctgaccgtcctaggtgggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactggaggacgtggtgtgctgccactcaatctacggcaagaagaagggtgatatcgacacctaccgatacataggctcttccgggacaggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgatagggaggttctctaccaggagttcgatgagatggaagagtgctctcagcactatccctacgatgtgcccgattacgctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaaactagtgcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 254 - DNA, 13017 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagcccgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggggatctggagctctcgagaattctcacgcgtgccgccaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccgggggtaccgaattcagcgggtcaggcggatctggaagtggtggtggagaacttgatgaattggtatacttactagatgggccaggttatgaccctatacattgcgatgtagtgacaaggggcggcagccaccttttcaattttggaagcggagctactaacttcagcctgctgaagcaggctggagacgtggaggagaaccctggacctatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 255 - DNA, 13017 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagcccgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggggatctggagctctcgagaattctcacgcgtgccgccaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccgggggtaccgaattcagcgggtcaggcggatctggaagtggtggtggagaacttgatgaattggtatacttactagatgggccaggttatgaccctatacattgcgatgtagtgacaaggggcggcagccaccttttcaattttggaagcggagctactaacttcagcctgctgaagcaggctggagacgtggaggagaaccctggacctatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 256 - DNA, 12891 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagcccgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggggatctggagctctcgagaattctcacgcgtgccgccaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccgggggtaccgaattcagcgggtcaggcggatctggaagtggtggtggagaacttgatgaattggtatacttactagatgggccaggttatgaccctatacattgcgatgtagtgacaaggggcggcagccaccttttcaattttggaagcggagctactaacttcagcctgctgaagcaggctggagacgtggaggagaaccctggacctatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 257 - DNA, 12891 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagcccgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggggatctggagctctcgagaattctcacgcgtgccgccaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccgggggtaccgaattcagcgggtcaggcggatctggaagtggtggtggagaacttgatgaattggtatacttactagatgggccaggttatgaccctatacattgcgatgtagtgacaaggggcggcagccaccttttcaattttggaagcggagctactaacttcagcctgctgaagcaggctggagacgtggaggagaaccctggacctatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgctcctgctgagtctggttattaccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 258 - DNA, 13143 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagcccgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggggatctggagctctcgagaattctcacgcgtgccgccaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactggggggtaccgaattcagcgggtcaggcggatctggaagtggtggtggagaacttgatgaattggtatacttactagatgggccaggttatgaccctatacattgcgatgtagtgacaaggggcggcagccaccttttcaattttggaagcggagctactaacttcagcctgctgaagcaggctggagacgtggaggagaaccctggacctatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 259 - DNA, 13143 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagcccgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggggatctggagctctcgagaattctcacgcgtgccgccaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactggggggtaccgaattcagcgggtcaggcggatctggaagtggtggtggagaacttgatgaattggtatacttactagatgggccaggttatgaccctatacattgcgatgtagtgacaaggggcggcagccaccttttcaattttggaagcggagctactaacttcagcctgctgaagcaggctggagacgtggaggagaaccctggacctatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 260 - DNA, 13017 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagcccgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggggatctggagctctcgagaattctcacgcgtgccgccaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactggggggtaccgaattcagcgggtcaggcggatctggaagtggtggtggagaacttgatgaattggtatacttactagatgggccaggttatgaccctatacattgcgatgtagtgacaaggggcggcagccaccttttcaattttggaagcggagctactaacttcagcctgctgaagcaggctggagacgtggaggagaaccctggacctatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgcttctgctgagtctggttattaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 261 - DNA, 13017 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagcccgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggggatctggagctctcgagaattctcacgcgtgccgccaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagggaagcctatcccgaaccctctgttgggtctcgatagtaccaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactggggggtaccgaattcagcgggtcaggcggatctggaagtggtggtggagaacttgatgaattggtatacttactagatgggccaggttatgaccctatacattgcgatgtagtgacaaggggcggcagccaccttttcaattttggaagcggagctactaacttcagcctgctgaagcaggctggagacgtggaggagaaccctggacctatgattcatcttggtcacatcctcttcttgctgctgttgccagttgctgccgcacaaacaaccccaggtgagaggtcaagtcttcccgccttctatccgggcacaagcgggagttgtagtgggtgtggatctttgtcccttcctatatacatctgggctcctctggctggcacttgcggagtgctcctgctgagtctggttattaccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 262 - DNA, 24 bp, Artificial Sequence
  synthetic oligonucleotide
gcttcccgagctctataaaagagc

SEQ ID NO: 263 - DNA, 30 bp, Artificial Sequence
  synthetic oligonucleotide
gatctggagctctcgagaattctcacgcgt

SEQ ID NO: 264 - DNA, 30 bp, Artificial Sequence
  synthetic oligonucleotide
cctgcaggtcgactctagagtcgcggccgc

SEQ ID NO: 265 - DNA, 23 bp, Artificial Sequence
  synthetic oligonucleotide
ccagaggttgattatcgataagc

SEQ ID NO: 266 - DNA, 492 bp, Artificial Sequence
  synthetic polynucleotide
ccgataaaataaaagattttatttagtctccagaaaaaggggggaatgaaagaccccacctgtaggtttggcaagctagctgcagtaacgccattttgcaaggcatggaaaaataccaaaccaagaatagagaagttcagatcaagggcgggtacatgaaaatagctaacgttgggccaaacaggatatctgcggtgagcagtttcggccccggcccggggccaagaacagatggtcaccgcagtttcggccccggcccgaggccaagaacagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccggg

SEQ ID NO: 267 - DNA, 1184 bp, Artificial Sequence
  synthetic polynucleotide
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 268 - DNA, 180 bp, Artificial Sequence
  synthetic polynucleotide
cgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttgg

SEQ ID NO: 269 - DNA, 592 bp, Artificial Sequence
  synthetic polynucleotide
taatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 270 - protein, 10 aa, Artificial Sequence
  Description of Artificial Sequence: Synthetic polypeptide
GGGGSGGGGS

What is claimed herein is:

1. A polypeptide comprising, from N-terminus to C-terminus:
   a) an extracellular binding domain comprising an antigen-binding fragment of an antibody;
   b) a transmembrane domain;
   c) a first intracellular signaling domain comprising an intracellular domain of a costimulatory molecule;
   d) a repressible protease; and
   e) the combination of A) an immunoreceptor tyrosine-based activation motif (ITAM) containing primary cytoplasmic signaling sequence, and B) a second intracellular signaling domain comprising an intracellular domain of a costimulatory molecule; wherein the ITAM containing primary cytoplasmic signaling sequence and the second intracellular signaling domain comprising an intracellular domain of a costimulatory molecule can be in any N-terminus to C-terminus order relative to each other.

2. The polypeptide of claim 1, further comprising a cofactor for the repressible protease and at least one protease cleavage site of the repressible protease.

3. The polypeptide of claim 2, wherein:
   a) the repressible protease is hepatitis C virus (HCV) nonstructural protein 3 (NS3);
   b) the cofactor is an HSV NS4A domain; and/or c) the at least one protease cleavage site is located:
   i) between the transmembrane domain and the first intracellular signaling domain comprising an intracellular domain of a costimulatory molecule;
   ii) between the first intracellular signaling domain comprising an intracellular domain of a costimulatory molecule and the combination of an ITAM containing primary cytoplasmic signaling sequence and a second intracellular signaling domain comprising an intracellular domain of a costimulatory molecule; and/or
   iii) between the ITAM containing primary cytoplasmic signaling sequence and the second intracellular signaling domain comprising an intracellular domain of a costimulatory molecule.

4. The polypeptide of claim 1, in combination with a protease inhibitor bound to the repressible protease, wherein the protease inhibitor is selected from grazoprevir (GZV), danoprevir, simeprevir, asunaprevir, ciluprevir, boceprevir, sovaprevir, paritaprevir, ombitasvir, paritaprevir, ritonavir, dasabuvir, and telaprevir.

5. The polypeptide of claim 4, wherein the polypeptide is cleaved when a protease inhibitor is not bound to the repressible protease; and the polypeptide is not cleaved when the protease inhibitor is bound to the repressible protease.

6. The polypeptide of claim 1, comprising:
   a) a polypeptide comprising from the N-terminus to the C-terminus:
      i) an extracellular binding domain;
      ii) a transmembrane domain;
      iii) a first intracellular signaling domain comprising an intracellular domain of a costimulatory molecule;
      iv) a first protease cleavage site;
      v) a repressible protease;
      vi) a second protease cleavage site; and
      vii) a second intracellular signaling domain comprising an intracellular domain of a costimulatory molecule; and
      viii) an ITAM containing primary cytoplasmic signaling sequence;
   b) a polypeptide comprising from the N-terminus to the C-terminus:
      i) an extracellular binding domain;
      ii) a transmembrane domain;
      iii) a first intracellular signaling domain comprising an intracellular domain of a costimulatory molecule;
      iv) a first protease cleavage site;
      v) a repressible protease;
      vi) a second protease cleavage site;
      vii) an ITAM containing primary cytoplasmic signaling sequence; and
      viii) a second intracellular signaling domain comprising an intracellular domain of a costimulatory molecule;
   and/or
   c) a polypeptide comprising SEQ ID NO: 35 or a sequence that is at least 70% identical to SEQ ID NO: 35 that maintains the same function.

7. The polypeptide of claim 1, wherein the antigen bound by the antigen-binding fragment of an antibody is a tumor antigen.

8. The polypeptide of claim 1, wherein the first and second intracellular signaling domain comprising an intracellular domain of a costimulatory molecule are, independently, a signaling domain from a protein selected from the group consisting of: CD2; CD7; CD27; CD28; CD30; CD40; CD 134 (OX40); CD137 (4-1 BB); CD273 (PD-L2); CD274 (PD-L1); CD278 (ICOS); LFA-1; LIGHT; NKG2C; and B7-H3.

9. The polypeptide of claim 1, wherein the ITAM containing primary cytoplasmic signaling sequence is a signaling domain from a protein selected from the group consisting of: TCRC; FcRγ; FcRβ; CD3ζ; CD3γ; CD3δ; CD3ε; CD5; CD22; CD79a; CD79b; CARD11; CD54 (ICAM); CD83; CD150 (SLAMF1); CD152 (CTLA4); CD223 (LAG3); CD270 (HVEM); DAP10; LAT; KD2C SLP76 TRIM; ZAP70; and CD66d.

10. A system comprising:
   a) a first polypeptide comprising a polypeptide of claim 1; and
   b) a second polypeptide comprising:
      i) an extracellular binding domain;
      ii) a transmembrane domain;
      iii) at least one intracellular signaling domain; and
      iv) a degron domain.

11. The system of claim 10, wherein the first polypeptide further comprises a cofactor for the repressible protease and at least one protease cleavage site of the repressible protease.

12. The system of claim 11, wherein:
   a) the repressible protease is hepatitis C virus (HCV) nonstructural protein 3 (NS3); and/or
   b) the cofactor is an HSV NS4A domain.

13. The system of claim 10, wherein the degron domain comprises a dihydrofolate reductase (DHFR) degron (DD) or a ligand-induced degradation (LID) domain.

14. The system of claim 10, wherein the first polypeptide is in combination with:
   a) a protease inhibitor bound to the repressible protease, wherein the protease inhibitor is selected from grazoprevir (GZV), danoprevir, simeprevir, asunaprevir, ciluprevir, boceprevir, sovaprevir, paritaprevir, ombitasvir, paritaprevir, ritonavir, dasabuvir, and telaprevir;
   b) the second polypeptide is in combination with a degron stabilizer bound to the degron domain, wherein the degron is DHFR degron and the degron stabilizer is trimethoprim (TMP) or an analog thereof; and/or
   c) the second polypeptide is in combination with a degron destabilizer bound to the degron domain, wherein the degron is a ligand-induced degradation (LID) domain and the degron destabilizer is Shield-1 or an analog thereof.

15. The system of claim 10,
   wherein the second polypeptide comprises from the N-terminus to the C-terminus:
      a) a polypeptide comprising from the N-terminus to the C-terminus:
         i) an extracellular binding domain;
         ii) a transmembrane domain;
         iii) at least one intracellular signaling domain; and
         iv) a degron domain: or
      b) a polypeptide comprising SEO ID NO: 39 or a sequence that is at least 70% identical to SEQ ID NO: 39 that maintains the same function; and/or
      wherein the first polypeptide and second polypeptide are physically linked to one another and/or flank a self-cleaving peptide domain.

16. A system comprising:
   a) a first polypeptide comprising:
      i) extracellular binding domain;
      ii) a transmembrane domain; and
      iii) a peptide domain; and
   b) a second polypeptide comprising a polypeptide of claim 1.

17. The system of claim 16, wherein the peptide domain is specifically bound by a repressible protease, optionally HCV NS3.

18. The system of claim 16, wherein the second polypeptide further comprises a cofactor for the repressible protease; and/or wherein the first or second polypeptides do not comprise a protease cleavage site.

19. The system of claim 18, wherein:
  a) the repressible protease is hepatitis C virus (HCV) nonstructural protein 3 (NS3);
  b) the repressible protease is catalytically dead; and/or
  c) the cofactor is an HSV NS4A domain.

20. The system of claim 16, wherein the second polypeptide is in combination with a protease inhibitor bound to the repressible protease, wherein the protease inhibitor is selected from grazoprevir (GZV), danoprevir, simeprevir, asunaprevir, ciluprevir, boceprevir, sovaprevir, paritaprevir, ombitasvir, paritaprevir, ritonavir, dasabuvir, and telaprevir.

21. The system of claim 20, wherein:
  a) the repressible protease of the second polypeptide specifically binds the peptide domain of the first polypeptide in the absence of the protease inhibitor; and/or
  b) the repressible protease of the second polypeptide does not specifically bind the peptide domain of the first polypeptide in the presence of the protease inhibitor.

22. The system of claim 16, wherein the first polypeptide further comprises at least one intracellular signaling domain; and each of the at least one intracellular signaling domains of the first and/or second polypeptide independently comprises an intracellular signaling domain selected from the group consisting of: TCRC; FcRy; FcRp; CD3zeta; CD3y; CD3S; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-L1); CD278 (ICOS); DAP10; LAT; KD2C SLP76; TRIM; ZAP70; and 41BB.

23. The system of claim 16, wherein the first polypeptide comprises:
  a) a polypeptide comprising from the N-terminus to the C-terminus:
    i) an extracellular binding domain;
    ii) a transmembrane domain; and
    iii) a peptide domain;
  b) a polypeptide comprising from the N-terminus to the C-terminus:
    i) an extracellular binding domain;
    ii) a transmembrane domain;
    iii) at least one intracellular signaling domain; and
    iv) a peptide domain;
  c) a polypeptide comprising from the N-terminus to the C-terminus:
    i) an extracellular binding domain;
    ii) a transmembrane domain;
    iii) a single intracellular signaling domain; and
    iv) a peptide domain;
  d) a polypeptide comprising from the N-terminus to the C-terminus:
    i) an extracellular binding domain;
    ii) a transmembrane domain;
    iii) a first intracellular signaling domain;
    iv) a second intracellular signaling domain; and
    v) a peptide domain; or
  e) a polypeptide comprising SEQ ID NO: 84, SEQ ID NO: 85, or a sequence that at least 70% identical to SEQ ID NO: 84 or SEQ ID NO: 85 that maintains the same function.

* * * * *